United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 62

SEQ ID NO: 980 - DNA, 758004 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcgg

SEQ ID NO: 981 - DNA, 81907 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatacta

SEQ ID NO: 982 - DNA, 102247 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatactacaagatgttctattgcatgcctccagctagagtgagcgttattgtatatatccattttttatagtcctgactgttatgtggcagttccagatattggaatcaaaaccagaatagtcacattctaataaggaagtctcatttttcttctcatacatctagcagataaaatatgatatgtacttactgtttcttcctcttgttaatatattttttaagtcttttaaaatagtctaaagaatagagggaacattttaaaatataagaggtactagattaatttttaaccttatattaagttgaaaaaagagattaaggaaaaattaccatttttcattgtttgataatacaaaaaaaaagtttggaaaaagaaaagataaaagccatatccaaactacagcacactcacgaaggcggcctggtgtggtagagcagaattcgattgccttagttccagtacaatcccaccaggtagttaacagcttcttggagttaccttttacctctgtaagcctgttttcttctctgaaaattaggatactagctgcctttccttttcttcaccatttttccccccaagttcacttttaagtcccatttgtactcattgtgttctaaatcagcattatcattgaaaaaataagggggaaaatgaaaaagtaacaaagccaaagtagacagtaaaatatatgtgaaaacagaagactgaaaagctgtctaaggtaattatagctgctatattactagctccctttattgccatttatagtcaattctctataaacaatgacttttctttttaatttttttcttgccaaaattagatagaatagtaaagcacttggcttactattcattctcttattttaaccagacagcttggttgccatttgcagttaattctctacagactgttgttttgtttttttttttttttcgtagtttttgcttaacaaaattatttaatattgcttaatgggcacagaatttccatttggggcaatgaaaaatgttggaaatagatggtggtgatggtacacgttttgattgcaatgaatgccactgaattgtatacttacaaagagttaaaatggcagtttcatgtgatatatatttttccacaatgttaaaaatagttttttaaaaaattagagctaatggtatagcacttaatccggtattcattctcttgtacattttaactaaatctctggtacaggaagttaacaacacaaagcttatacccatattcaaatcttagctgtaataccaaaaagttaccattgtctgactgtcctttctcatgccaacaatcaagttgaccataaagggagaacccatgtggtctaattttacctttttaggtataaactgtgaagaagaagcagagagctcctgttgtcttgcccaccttataaaacgttttcctctatttcaacatttgactagttacacactgataatcatatggtgtgcctttttagaactatctttccccagtaactcatatttgggaggataataggaacttttggaatttcaatttttgcttctgcctgaaagctgttcggctggataaatttctatcatctagtttgccagatgtcccctccagagcaattctttgagttttggtaacctttatcttcaacctcctccctactcagctgtgttgaagatgcacaagggtcttgtcgtggatgtatcaaaggtctgtagcatttctcctgtatatttcagtcatctattgacatgtatttccaaagcctacaattgatcaacatccctttcccaaattatttttccccacatcactaaatttaaaattgttctcaactgagtcatcctatttctaagaaattaaagagttgtttatattggggaaaaaatattttaaggtggcagattgttaaattaatgttgcgtattacaattaaatggaatattccctcctcagactcaaaacacaatgtcacttctgctgggtaacagctaacagtggaaattacatgtgtttaaagttgtcttttctattaagttaatacataatggtctcctttcctaagattatattgatctattaagttaagctattttaagaaccccaaaagctacatatacatgacttacaaaactaatttactttcctatgacaatgccaagcagattgttaaacatttgctttctgaatacttactaccctcgctattctgaaaagcatggtttaacaaagtctgcctaactctgtcaggaaaggagtttttaaagtttcaatgctaaaaatcactaatacttaatattttctaataccttaacaatgaggttttggaccaagtaaaatatccaggcaattgtgggtttgcttataagtgcaaacttaggatttttattttaaaaatttcttttagatttgaacatataaaattttaattcaaactttttttttttttttttttgatacagagtctcactctgtcgcccaggctggagtgcagcggcacgatctcagctcactgcaacctccatctcctgggttcaagcaatactcgtgcctcagtctgtcgagtagctgggactacaggcatgcaccaccatgccctgctactttttatatttttagtagagatggggtttcaccatgttggccaggctggtcttcaactcctggcctcaagtaatccacctacctcggcctaccaaagtgctgggattacaggcttgagctaccatgcttggccttcaaacactttttctgtttgtgctttcagtaaaattttattaagagtcttccctgtgtttggtgctgaggatacaatgagaaatcagatgatgttgttggccttttgggggatctctgctgtcacacttggctgattttactggaattgtttttgaaatttttttttatgcttccttccgtttgtgattagaggatatagaacatgatctcttaataaccaagtaattatgaacaacatttttcttgcacttaggaaccccgaggcaatgagtctgccccctccacccctccacgctgctgtgctatcgcaggtggtccttctctgttcgctttcccagatctccctatcatttctccccgcccaggttctcttacttccctctttctaccattgtgtttgtggtagagcatgctggtttgttctttctttgccagctttcccctttcctcttgtctgtctgctttcattttcttgccacttttgcattgcccagccttggctccagtggaatttggttttgatcatcattgccagcccagtgcaagcacttgttttgttgtgttgctttgaacagttggattcatcagatcaaatgaaataatttacataaaatgtcacagagaactaaaaatgtctatactatttatatagtgacatgtataaagggaacttgtctaggtttggaaagctttttcaaacccagtaatttgctatgtaaagtgatagcttaatatctgaagtattgctattctttcttacataaaaaatagcatgacacgttatcatcaaaagtatagtttatactgtatactgtttttaaaaagcatcaaaaattttatcctcctttcatagatttttaagaaaaaaaatgatcacatgtgcattgtcagacaacacattggaaagatttactcgtttattctctcattctgtaatttttattgagtgacttctctgtgagggccgcattacagatgcagtgactgaaaatacacgtaaggatttttatgcagatgaagcctgcaatctaacagtcgtctggcaccaagtgtgttgtctttttgctgaatttgaacatcccatagtttttggcaaaggatgaaattgtattataatacctataatacactgacgtgatgattttagtgtcagaacccaaaccccctttactcaggaacctgatcatgcaaataaatcatgtgtttgtttggttctggaacctggaagagttgcattatcttctctttaaactcttcagctgttcctcctgtagcctgagactcagagggagctcctagcatccaaacttgaacgaaatgtgccatgtaaactcagagtgccaggatgacccacgggggtgcgcactcagcttgtacagactcttacacacatagagatgaggtagctgttttctgaacaagtgaggttgaaattgaatgttggatacattttacgaaagttaatctatttttgaacattgaaaataatcatagtatgtaattcagaggtccccttgtgagcagattttagcaacatgatatgctgtgtggagataaaccattcatttttcttcattaacatctacatttataatctgcttgcagaaatgtcatatgttcagaaaaatatattaagtgtttcagattgaagtgatttttgtttttagaaataatttcattatttctaaaatctgaggaagaagccctgtgttactgcttgggtctttagaaagcttttaatctggccgggcacagtggctcacgcctgtaatcccagcactttgggaggccaaggcgggcggatcacgaggtcaggagatcgagaccatcctggctaacacggtgaaaccccgtctctactaaaaatacaaaaaactagccgggcgtggtggcgggcgcctgtagtcccagctactcgggaggctgaggcaggagaatggcgtgaacctgggaggcggagcttgcagtgagccgagattgcaccactgcactccagcctgggctacagagtgagactctgtctcaaaaaaaaaaaaaaagaaagcttttaatctaggagagagcaactcatgttccttgccctctgtctagattagcaacatttacttaaatgttttcagaactgcttgtatcacatgaagcaaaatacaggggaggacataagttcacagtgtctagtggggagaaaaatgacaacccagattgctcctggatttgcctttagagaagctatctaatcgaagctgtgagttttcttccctgttgcctattaagtgaggtagttatttcttgactagatagatcactgggatcagggaagttactttacgactagctgctgtgggattctcttgccaagtgaagatgggaggctagcactaagcagtagtcgcttatgaaatcacattggtagctgctctatggatccggaacaaaagagggtcttagaaacagcaatcatggttgttctgcccagaatggctcttttgagaggagcaggggaagtccagcctcctcacaatagaagaaatgcagtcttccaataatgtaagaggttttagaaacaatggttggcccagaatttatgtagatatctaaagagcgcccaaaggaaaacccaggaattacctgttttccaaatggcctcgtccttgccttttgtttttatcatgacctctacattttctaattaattaatgcttctcttgatagccatgtctcttgcgcaaagctctttttcttttcctttttaatcactcttttaatttatatttgtactgctcttcctggacttttgcagtagttacttaataagtttccctgtcccttgtttcatcttctcccctccaaattggtcttacgttagcactctataaacttggggtctcaaactggtacccaaggagccagtcaggtattagaagtcaatgaaatgagttaggtgtagagtgataggaagaaggtttccacgccttgtctggaagtatacagcttttttaaactccacagattaaaccaaccacagctgagggttcttgatcgaacacacggactgtgagtttaaactcctgctatgaaacacttttaaactatcattcctttcccacggctctctttacctgcaggataaaggctgtactactcgacattcaggactcctgtcatctggcccactctgtctccccaacgtcatcttctgtcctggggtctcagactataccgtagtcagactggccccctcgccacctcccagatacaccttgcatgtcgtcacgtttgctcttttccctctgtgtatgtcagctccaccctgaggtgagcaaccttctttccacatacctatctcttcccagccctccacatctaggtcatggctttttagcatggagagtaccaaacagtgcctagctcatggccagtactcagtaagtgctagctgatgctatgattccctgatcactggagtccagaagtttgtttctttcaaacaattcctcggaacttcaaatgaggttgaggctggaacatcactcttcccaaagtcctgtctagctgtaatctctctctgttatcgtaagacgcacacatactgtcttctacatcaaactgcaaactccttaaagatacggattctgttaaatacatctttatattctctgcaaagctaatacaggctgttgtaaataacagccactatacacagtaaggctttttttcttagttcacttataaaaataaatatcctttaatgatagatttggttttgattattttcagtgaaaaagctacattactcaaacaagtatttgctaggtgctatctatatgtaaattgcttatctgtgtttttttttttattctttggcatatttagtgagcacctactatattatagaaactaggaagacagcgctgaacacagatcaagtccctgctctcataaagcttactttctagagggagagacacgtaataagttaacataaaaacaaaaatatagttttggatactggaagaactattaaagaatttcagcaaggtcaggggatttaaagtaactgaactggcagctatttaaacaattttctgggccttaaaaatgggatcatatcttgacattctcatttctttttctattttgtacttactaaattgcccccttaagcaagcaaaacaaattgcaaaaacatgaggtaatgcctcacctagaaacttagacacattgtaaaactcctgtgatttttttaaaggctttttcctttttaagtgaatcttttaaagattcgacattgatgtacttcatcatcatgcgtttttccccttgtttgccttctccctgtattgcagtgttctaagatgcagtgctgtgggtctgaggtgaccgccgtgttctttctggaaaatggctgctgcttacagctggtactccctggcccagcggtgacatgtttttatcaatctgccatagaaggagccatgacattagtctacttccagattaatcaaatgacacaaagatctttcatctaatctcctcttcccctgtgtctctagatgggcaaatttggccattagtttaagtatctcataaatgaggtgatgtgtaagataagaatttttgctagagtcttatttgaaagttctattaatcttgttttaattgtaatatatattatagcatatggcataaagcaacattttaatagtcatagaaaataagatattttcacattaaggaactggcaagaggtttgatactgaatttgttttcaaactctaccagctactggcactgcaagcttaagcaagttactcaagcccttgaagcttggcctcttcgtctgcaaaatggggctgataaggcttctaaaagagagttgtgaaaattaaatatgatatagtatgtaaatatcgttacataaaatgtacacatttactaaattatagttgttattatggaacccaacactaaagaagcgggcagagaatatcacttgtttctgtagttaggaatagtagcagtaaatttgacatgtgccactatagtgaaattgctggcacttaagttatttgtcatatactataataatatgatttatgaatgttaattctcaaatcagttggaagccaactgtgtgttcttgttcagaattgaccaacctagaggttctgaattgagtgaaacctatatcattaaaagaatgtgacttggtatctgttttcttctttaattttgtgaggaggcacttccaacagcagtgtgtctctgaatatttttcttgtcacattaggattcactattccagaagagttgcgaataattttgttttcacaactagttcattctgaaaatgctatttaaggtggtcactgatatttgaggggaagtgtgggaagaactatttatttgcaaatacagaagactgggccagatggaattttttttaattctgcatttattcatagagcaccacccgtaacaattacattaattatagctcagacattctttttggtctcaatagaagggcttggtatatttgtttgggtaagaatttggcaattgaagtgggaaactaaatttagttttaaggctttattttttgagatttaaaaattcttcaccttttaatactgacactatagttttaaaaacaatggaaatatttttaagaatagtctggggccgggcacagtggcgcaaatctgtaatcctggtgctttgggttgcttgagcccaggagttcgagaccagcctgggcaacacagcaaaaccctgtctccacaaaagaatgccaaaaacattagccaggcatggtggcgtgtgcctgtagtcccagctacaggaggctaaggtgggaggattgcttgagcctaggaggttgaggctgcagcgagctgtcagcatgccactgcactccagcctgggcaacagagtgcgaccctctctcaaaaaaaacagacaaaaacaaaacaaaataatagtttggagggaacacattgctctatgccctaaatcagcagcccagtgtattttagaaacacttgtcagtcttttgagtgagaccccaaaccgagaccatgactttgttttgtcttacttgcccttcaagtatgaaattgaggcaaaccccaccaaacttgtttcttaagatctttatgttggactgccctgaagtggtaagaaaaaattctgttacaggtagatctgaactgcgcccaaaactctcgcaaaaatagaaaggctcgatgctgtccgccactcccacctgagagtgcctccttggcctgcatctcttatgcataagcttggcccaccgtcccttgttctccatctgtaggctgtagaatcagaagacagttacaacagaaagacctagagaagatcactgagcaagaactgaaaggaaatgatggaaaagagcagactccttcacttcagacactggggcaggccctgctgaaacaaaagggttttggtggcagaaaaaaaaggcgtggttcgatttttagcaagaattaaggtattgtgacggagggggtgtcaaaaatgttagcccatcccacacaattgtaatttctcatactctgcttctcccatctttaaaaagaattcagaaaaagttgccagagttcattgccacccatagtaaataaggtgggaccacctgacaaggcttgtatcccttagtgttgacttccacagccaaacaccaccctccctggttgaggctgagcaggagctaaggcagggacctcacagccgctgcactaggaccagctctaggttcagttggctcattctgtgcctttccagatgatttcaggagcttctcttcctctgtcaacatgtttgttcctatttgcattgtcttttgatttatggcttgtatccgtttcttgaatttatagatgcagaattcatatcagaaagatcaattaagagcaacacaactctggggctcatctttaaaactattcttaatagggttgttttttctaagtagttaaaacggcaccttgaaaatccctgtggtaggtgaattcaccattggtaagtgtatgacagtattttatggagaaaatagatcgtgaaggaatcaataaacttcctccccgcttttaaaatttttggaaaaattttagaacagccagattcaagatcctctccttttttttacatgtactaaaaattaaaagaatatcaatgatacatctttagtagtaatgtattcatgaaaattaattcttgttttccatcttttgctctttacaaactggttaagactgtttccctctcagtgtcagcaaggtgcttataaaacctgttttctctgttgtgtgagggagttctttaatgacgatgttgctttcttcatatatttgtactttaccatttcaaggccactaaagtacttctgttttctcagaacaaggacttctgaaatacattatttcctataaaaagaaaagaatatattgttggcttgttgattttttttttgagataatggtttctatagacccacattcagggaagcatagtcaaagactatcttggtctatttggccctaaaagccctaagatataaaaagaactaatcgaatctgtaatatttatgcatagcgcattatcgaagatggctggctggaactgcaagtcatatttagtgttttatgctattgattagataaatgacattagaggccatcctcagcttagtcactgaggccagcaagtcactgatgccagcaagtcactggcctgatgccagcaagtcactgacatcttcggtgttaggcccacagtgcctgcctgtgtcatcacctacagcttgtagcaatcaggcaactaacaagttaacttctgtgactggccctgctgttcaggggccttcggcaaggcctcctgcttcccagcctggctctcccacctgctcctcttccttcttcctgcaccttggagtctgttagctcctaaatggcgagggtttttggttttgtttctaaataaggggtggaacataggcaggagagaggcagcccaagtgaaagagctagaaggcaacatataaaggggtggggtgggtgtctgaagagatattaggcagcagactttttctaggaaaggccaaattactaatattttaggctctatgatctcttagaaccgcacagtgccattgtagcccagaagcagctgtgcacagtgttcagatgaatcggctcagctgtgttccaattaaattatattcacaaaagtaggcagcactggcctttggcctgtgggccatagtttgccaacctctgcatactagaaagtaatatgtcccaggccgggtgcggtggctcacacctgtaatcccagcactttgggaggccaaggcgggcagatcacgaggtcaggagatcgagaccatcctggctaactcggtgaaaccccgtctctactgaaaatacaaaaaaattagccgagcatggtggcgggtgcctgtagtcccagctaccccggaggctgaggcaggagaacggcatgaacccgggaggcggagattgcagtgagccgagatcgcgccactgcactccagcctgggcgacagagcaagactctgtctcaaaaaaaaaaaaaatgtccctagtaaactggctctgagagaaattctggaagtccttaaaatattgtgagcagtagagcattatttagtaaatgcgtagtttctcagagaaactgaggacaacactttaatgttaaaagcttggtatctaaatatattttaagcttcatatgttcatttgtttaaaattgctgatgaatgaaaaaagcagtggaggattataagcatttattataaagcaaaacccagtgctaatgacgaagcaaagaggggactgtgagtgatcattttaccgataacagggaagttaagctacaaagcaaggtgttctgatttccagtcgactgaacacgtcatgctgcctgtccccggagtgagttcaggggttaaaaaaggaaaccagggttttggacttttgtgtttctcagtcatctgcagagaagtgaaagttttattctgttagattttgatgttatttttttctataggaattggatacccctgtaataaaaattcaaatatctgttgaatgagcctttttatagctacatgtagagatgtcccgccttaataaaagaattataggttcttataatttctgacaggttgttcctactgaaggattggtctccatattaaagaagaggaatgatactgtaggagatcatcctgcccaaatgcaacacaaaccatctaagcgaagagtgagattccaagaaatagacgatagcttggatcaaggtaaaccgcttggcactgtggctagcaggatagatgctcagtgtttgctgaaaggatgagtttgtgaatgatgtgacgtttactaacaggatttgtaaaagactatgtccgccaggcacggtggctcacacctgtaatcccagcactttaggaggctcaggcgggcagatcacttgaaatcaggagttcgagacaagcctgaccaacatgacaaaaccctgtgtccactaaaattagaaaaattagcgagtgtgggggtacgcgcctgtaatcccagctactcaggagactgaagcaggagaatcgcttgaacccgggagacaggttacagtgagccaagagcgtgccactgcacttcagcctaggtggcagagcgaggctccatctcaaaaaataaatataaataagtaaataaaagaatatgtcagtttagttgctttatcttctaagggagaaacatataaaatccaactatcatcttaaatcatttctaaatctttacttgcttaaataagtgagcaagctgcaaaattcaacttgtggcctccctgttccatagacagttaatgttgagagcttagttcagtttccctctttagtactttttgtgtgagtctgctatttttgtcttttgttgtttttttgttttttttttaagacggtcttgctctgtcacccaggctggattgcagtggcgcaaatcactgcaacctcaacctccacctcccaggttcaagcaattctcctgcctcagcctcctgagtagctgggcttacaggcacatgccaccacgcccggctaatttttgtatttttagtggagacggggtttcaccatgttggtcaggctggtctcaaactcctaacctcatgaggttaggatctgcctgccttggcctcccaaagtgctaggattacaggtgtgagccaccgcaccaggccctggctagttttctgtatttttagtagagatgaggttttgccatgttggccaggctagtctcgaactcctggcttcaagtgatccacccacctcggcctcccaaagtgctgggattacaggcatgagccaccatgcccggcttgtcttcttttcagtggacaattaatactcctcctttattgtggaaaatatttatgaatattctcttcagtgatttcctcttcattgatagaaaagagtgtctctcgagagcagcagttttacaccattgctgctgtttgacttcttcgtcctgggcctgtcaaacttaaggccctgacttggtctaacatgaggtggtgagttttgtagtgaacaatgctgccttttatggttgcaaatatgtttatctaaggtgtaagtaaataagagtaaatggaaaggtaacccagaacctgtcagtgggcttctcatattcataaaacaactgcattgttaaaataacagtgtaaatatttaggtatgctttctgggtgtgacataagtgataacagtagaggtttctgcatttttacaattagaaagctggttagggggccttagaaataatgtcctaacccctgattttacttctgcaccttgcttgtaactctcacagtcttctccagataaggtgctcacttctgtttgcactaatttgaccaaatcgttccttaataggaggaaccccggatttgaaactcacagtctgcatttcactttgtagccacctcatcttaaactaagtcacttacttgtaggagactgagttccatcatctttaaaataaggagaataacatctgcctctctgtccctattgaaaagcgtgtcagataatatgtataaattcattttgagaattataaaactaaatgtaaatgttgattgtgttggtttgttcctaagctctgtgacttacacggtgttttcataaacctcaccttctgccaaaatcttcctaaaagggcctgttcttccttctgtaagccaatgctatcccctggaaattaatgtgaggcacatgtatgattttcagctttgtagtagccatgttaaagtgaaaagaaacaggtgagatgaattttattttttatttgattttattttttttgagacgggatctcactctgtcgcccggctggagtgcagtggtgcgatcttggctcgctgcaacctccgcctcccgagttcaagcgattcttctgcctcagcctcccaggtagctgggattacaggcatgttccccgacgcctggctaatttttgtacttttagtagagacagggggtttcaccatgttggccaggctggtctcgaactcctgacctcaggtgatctgcctgcctcggcctcccaaagtgctgggattacaggcgtgagccaccgcacctggccagaattttaagaatgtattttatttaacccagtacataaaaattatttcaaaatgtgatctatatgaaaaaattactagtgagacattttacatcctttttttcacactaagtattcagaatctgtgttcatcgccgctcagtttggaccagctacatgtcaagtgcccaacagccacctgtggctcacatcggacagtacagctcagacaggtctaggacatataaataaaacaaacagcatagatgcttttacatatttaagctatatttaaatgtttggatttgaatatatgataatgaagaaaaatactttaggttgttaacatagatgaagtgggggtaggaatcatgttaagaaaagcacgtaaggcatggtgcagtggctcacacctgtcatcccagcacttggggaagcctcctcccaagtcttcctcctggatcactcgaggccaggagttggagaccagcctgggcaaacatggcaagaccccatctctacaaaaaatacagaaattagcagggcatggtggtgtgtgcacctttggtcccagctacttgggaggctgagatgggaggatcgcttgagcccaggaggttgaggctgcagtgagtgtggcctggtgacagagcacaaccctatgtctaaaaaaaaaaaaaaaagaaagacaagaccgaactgtccaaaaaaatacagcatgattaatatgatcctatttcttcatttatataaaagacatattttcatacataggtataaactattttagactgggcgtggtggcttatgcctgtaatcccagcactttgggaggccaaggcgggcaaatcacctgaggtcaggagtttgagaccagcctggccaatatggtgaaaccccatctctataacaatacaaaaagtagccaggcatgatggcaggtgcctgtaatctcagctacccaggaggctgaggcaggagaattgcttgaacccaggaggcagaggttgcagtgagccaagatcacaccattgcactctagcctgggcaacaagaacaagactctgtctcaaaaaaaaaaacaactattttaaaatgtaaatttcagagcaaacaattttttaatcctattttgatgtaagtcctgaaatcatacgtgtttgatctgaaatgacacacaccaaatttaacagtgtttacctctgggatgggaaggaaatatgattgggcgggagaaaaacggatagtcccttagactctaagatgcttttggggttgcgtttttacagggagaatatattcatgtattactgcacaatgttctaaataaagtctatttggtatccattaggttttgtaaaatttgtttcttgtaaaaatatatgctaattatgaaaaaaatcagtttaataaagtaaaaattaaatcatgagtcttagacatccttcaatgaaagaacatattaaatttacttcattctattaaatacttacatcatattccattatataaatgtcccataattgtttaactgttccattgtaaccagaaccactaagttattcccagccttttgttataacaaaccctgctgcagtgaacaagcttgtatatatgatatttgttgtgcagaactgtagcctaattcttaaaggtggatttgctgggatatgttgaaactatatgtcccaggtggcctgaggccgtcctggtttacacctgttgtcccggaattgcattcagttaacactgtctttttttctttttttttttttgagaaggagtctcgccctgtggcccaggctggagtgcagtggtgtgatctcagctcactgcaacctccgcctcccaggttcatgccattctcctgcctcagcctcctgagtagctgagactataggcacctgccaccacgcccagctgattttttatatttttagtagagacggggtttcaccgtgtcagccaggatggtctcgatctcctgacctcgtgatccgcccgcctcagcctcccaaagtgctgggattacaggcgtgagccaccacacccagccttaacactgtcttttactctcaaaattgtccagtctgtaggataaattaattttaaattttaatagatactgccaaattaccttccaaaaaggcattcctacactttaatcatgctgcagatcagaagactttttggtctttttgaaattaaaattttttttaaattatgaataattaagatatttttcaaccaaagaatgattgttttcttcaatatagaaagatgcaaaagagatcccacccaaaggcatttttattgtttaatattaagtcgactttgctctcaggtagtcccattatgtgaaccccaaggatcttagaacagccaggctgtactgtagactgtcaaataatgctgtcggggtgggcatgctggctcacacctgtaatcccagtactttgagaggccatgacatgaagataacttgaggccaggagttcaagaccaccctctgcagcatagtgagaccccatctctaccaaaaaataaaaaataaatagccaggcatggtggcacaggcctgtagtcctagctgctcaggaggctgaggcaggaggactacttgagcccaggtgtcagggctgcagtgagccaagattttgccactgcacttcagccagggtgacaaagtgagaccctgtctctaaaaaacaaacaaaaatgaatgaattcattaatgcgtgctatgagcacgtgagctgtttttcttcttctcatggagtgattctgtccattgtataaatgagctagttttaattttagcttgtacaagctccacaagtctgaatcttcttggtatttaataggtaggtctttgtagagtcattagcagcatgagttttctgtcaatacttcctatccgtagaggaccaacagtagaaatgtgtagttatcttaattagtgaaaagacagcagatgctaagatttccatttcggtgacaatgtaacctcactctttctcatgtttgcagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggagga

SEQ ID NO: 983 - DNA, 25704 bp, Homo sapiens
cttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactag

SEQ ID NO: 984 - DNA, 8250 bp, Homo sapiens
gttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtg

SEQ ID NO: 985 - DNA, 54084 bp, Homo sapiens
taggctggaaagtggaggatccggtttgctctgggcgggtctggaagcagagccggcggagggagcgccggggccctgggctgcaggaggttgcggcggccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttggtcttgaactcttgatctcaggcaatgcacctgccttggctttccaaagtactgggattacaggtgtgagccaccgcgcccagccctctagttgtttttcaagacagtttttggggtgcgggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcattgtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacgtcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatgctctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgaataagggccgttgtatatggagccaggcaggaaattgatgatttttatcaagaacaatttcaggccaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaacaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaacccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagtgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagttttttttttttttttttttttttttttttttttgagatggagtttcgctcttgtctcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcctgcctctgtgggtgtggactcagtgtcgacagccccctctacaggagcatgaacacgctgacagggtgctggggtcggggggcagccctgggttcacgctccgccctcgcacccccagagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtctctgtctctctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctgtcgccatctctctgggtctctgtccctctctctctgggtctctgtccctctctctctgggtctttgtccccgtctctctgggtctctgtccccgtctctctgggtctctgtccctctctctctgggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttgaacccgggaggtggaggttgcagtgagccgagatcaagccactgcactccagcctgggcgacaaagcaatactccatctcaaacaaacaaacagactttattttgaaatttctcatacatacagaaaaatgcacgaaggtggacagcttgatgcatttttttctttttttgagacggagttttgccctgttgcccaggctggagtgcagtggcgcgatctcggctcactgcagcctctgcctcctgggttcaagcaattctcctgcctcagcctcctgcctcagactcctgagtagctgggattacaggcacgtgccatcacacccggctaatttttgtatttttagtagacggggtttcaccgtgttagccaggatggtcttgatctcctgaccttgtgatctgcctgctttggcctcccgaagtgctgggattacaggtgtgagccaccgcgcccggcctaatgtttgtatttttagtagagatgaggtttcaccttgttggctaggctgttttcgaacttctgacctcaagtgattcgcccacctcagcctcccaaagtgctaggattacagacgtgagccactgcacctggctccggctaatttttaaagttttttgtagagacagggttttgccatgcagcccaggtggcctcaaactcgtggtcgaaagtggtccacctgcctcagcctcccaaagtgctgggattacggtcgtgagccactgcgcccagccagccaatatcttataattttatcaaaacatgaacaagatacattactaggtttgaggaaagtttttgatttttgtgtatttttcttgtatcaatcctcttaccaaattttcttattgatctttatttttatttttggtggggttttccaattttctgggaatacaagccatgttttcttcaaataggtacttttgtcccttccagctttacaaaaaaccaaaaaccaaaaaatcaattttcacttcagtgatttcatttttttgcattattgagttagctcaaaactccaggatgaatacagtgttagtggtaatgtggtctagtttctaatttatttatttatttttttgagagggagtcctgctctgtgcacaggctggagtgcagtggcgtgatctcagctcactgcaacttctgcctcctaggttcaagcgtttttcctgcctcagcctcccgagtagctgggactataggcacgagccaccactcccagctaatttttgtatttttggtagagacggggtttcaccatgttggccaggctggtcttgaactcttgacctcaggtgatccacccgcctcggcctcccaaagtgctgggattacaggcatgagccaccgcacctggcctagtttctaattttaatggaagtagagtcgatatagtgctatctttatggtgcaattggattttggtaaatatctatattgtggttagatagccctttctattcccatttcctttactttctatttgaactttcactccctctggctcctggatggttaatcaatgacaggattgactcatacaagaaacacctgcctcattcagggactcaggagtctaggtcctcagccccctcctccctggggaagttaagcattactgtcttcaaaatctagctccctcctgaagtgtccaaagacatgacaattctggccaggcgcgctggctcacagctgtaatcccagcactttgggaggccaaggtgggaggatcccttgagtccaggaattcgagaccagcctgggcaagatggcaagacccctgtctctaccaaaaattaaaaagttagctgggcacggtggtgtgtgcctgtggtcccagctacttagaaggctaaagtaggaggatcaagatgtagtgaggtgtgatcatgcccctgcactctatcctgggcgatagagtgacaccctgtttcagaaattaggctgatgcggtggctcatgcctataatcccagcactttgggagtccaagttgggaggattgcttgaggccaggagttcgagaccaccctggccaacatagcaagacccccatttctaaaataaatacataattaagtaaaaaaagaaatgacaattccaatgagcctctgaacagaagattaggacaaggctgatgtttgccgactcctgggaaatgcggttttctcctatctccagcaaaggctgatgggaggtaatcaagcccccttctcttcttgcctcagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtatgacactgggggcccaactctggatcctgagatgggagggaactggggacttgggctcctgggtctgagggaggaggggctgggggcctggacttccaggttccgggagaagagggtgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacacatccactgacaattccattcagtcattcttccatccatccatcttctcacctgtccatccatgcatccactgacaattcctgagaatgccatctgctcattcttccatccatccatcttctcacctgtccatctacacatccaccgaaaattcctgagaattccatccactcattcctccatccatccatcttctcacctgtccatccacacatccactgacaattccattcactcattcttccatccatccatcttctcacctgtccatccacacatccactgacaattcctgagaatgccatccgctcattcctccatccgtcttctcacctgtccatccacacatccactgacaattcctgagaattccatccgctcattcctccatccgtcttctcacctgtccatccacacatccactgacaattccatccacttattgttccatccatccatcttctcacctgtccatccacacatccactgaaaattccattcactcattcttccatccatccatcttctcacctgtccatccacacatccactgacaattccattcacttattcttccatccatccatcttctcacctgtccatccatgcatccactgacaattcctgagaatgccatctgctcattcttctatccatccatcttctcacctgtccatctgcacatccactgaaaattcctgagaattccatctactcattcctccatccatccatcttctcacctgtccatccacacatccactgacaattcctgagaattccatccgctcattcctccatccatccatcttctcacctgtccatccacacatccactgacaattccattcactcattcctccatccacccatcttccatccatttacccatctacccatccatcttttcattcatccatccaactgttcttccatctatccatccacccacccattcttccttccctacatgcttccaatatacatgaagcactctggctagacatgaaccaaagcactgtctcccagtgaggaagtccagatatttcactagaaatggcagcttggaggacggaatgatgaaaaccaaggcgggggagcataatgcacacctgggagaggctggggagggtcttatttatttattcacttattgagacagggtcttgctctgtaggccaagctggagtatagtggtgtgatcacggctcagtgcagcctcaacctcccaggctcaagtgatcctcccaccccagccttccaagtagctgggaacatacccgcccaccactacacctggtaaattaaacaaaaaaaaaattttttttttgtacagacgaggtcttgctctgttgcccatgctggtcatgaactcctggcctcaactgatcctcctgcctcagtctcccaaagtgctgggattacaggcatgagccaccatgccagcctcctttatttagtcaacaaatacaatcctaggctccagagactaaagccaacccatttcctgctctcaaagaccccagatcccactaggattgtttggatacaaccttaggtaaaatttaagacagaagcacaggcaagaatcactgtcgttagaaggaaaacttcaaggaaaagttgtgtgtgtgtgtgtgtgtgtattttgagacagagtcttgctctgtcgcccaggctggagtgcagtggtgcgagcttggctcactgcaacctccgcctcccgggttcaagcgattctcctgcctcaccctcctgagtagccgggattacaggcacgtgccatcatgcccggctgatttttgtatttttagtagagacggtgtttcaccatgttggtcaggctggcctcgaactcctgacctcatgatccatccacctcggcctcccaaagtgctgggattacaggtgtgagccactgcacctggccagagaagttggcatttaaaccggaccttggccaggcacagtggctcacacgtgtaatttcagcactttgggaggctgaggagggaagatcgcttgagcccaggagtttgagaccagcctgggcagcatggtgaaatgccacctctataaaaaatacaaataataagttggggagggtggcgcatacctgtaatcccagctacttgggtggctgaggcaggggaatcgctcgaacctaggaggcagattgtgccactgcactccagcctgggtgatagggcaagactctgtctcaaaaaaaaaaaaaaaaaacctaaataaataaaccaaataaactggaccttgataagtcagtagaatttggatttagtaagctaacgagtgggacagataagtattcaggaagattcccagggctctgtgtggggagggtcatttttggtgtcagaagaacttttttctttttttttttgagataaggcctcgctctgttgctcaggctggagtgcagtggtgtgatcttgacccactacagtcttgacctcctgggctcaagagatcctctcacctcagccccacaagtagctgggaccacaggcatgtgccatcatgcctggctttttttttttttttttttttttttgagacggagtttcgctcttgttgtccaggctggagtgcaatagtgccatctcagctcactgcaacctccgcctcccgggctcaagtgattctcctgcctcagcctcccaagtagctgggattacaggcatgcgccaccacacctggctaattttgtagttttagtagagatggggtttctccatattggtcaggctggtctcgaactcccgacctcgggtgatccgcccgcctcggcctcccaaagtgctgggattacaggcatgagccactgtgcccagccttttttgtatttttagtagagatggggtttcactatgttgcccaggctggtctcgaactcctgggctaaagctatctgcccatctcggcctcccaacgtgctgggattacaggcgtgagccattgtgcttaggccagaagaattttacgggggaaatacacactaagatagaaactccccagatacacggtggcaatatatacagcattctacctcagctccccacccatgtttgtggtgtggtatatattttaattatttttcttattttaattatttctttctttttcttttttttttttttgagacagagtctcgctctgtcgcccaggctggagtgcagtggcgcgatctcggctcgctgaaagctctgcctcctgggttcacgccattctcctccctcagcctcccgagtagttgggctctctatttttagtagagacggagtttcaccgtgttagccaggatggtctcgatctcctgaccttgtgatccacccgcctcggcctcccaaagtgctgggattacaggcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttatagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtggagataatatcttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaatacggcagctctgcaagatgtggtttgagggggtggtgttgtaagcccagcaggagtggaagtgatcacagtccactgggggaactggagatggctgataggcttggggatagcagagttgaatggatggaatttcagcaagaaagaagggcaaggtcatgaatgcgtcttttttttttttttttttttttgagacagtgtctcgctctgtcgcccaggctggagtgcagtggtgtgatctcagctcactgcaacccccgggttcaagcgattgtcctgcctcagcctcccgagaagctgggactacaggcacctgccactatgcctggctaatgtttgtatttttagtagagatggggtttcaccatgttggccaggatggtctcgaccttctgacctcgtgatctgcctgcctcggcctcccaaagtgctgggattacaggtgtgagccaccacccctggcccatgaatccttcctaagagtctagcataggcaggcccagtgctgggcagttggtgtactcttttgcccttcatctcccttccctgcctgcaaggattatcaccccattttgcagatgaagagactgaggctcagagagaggaaaaatggcttgcccagggtcatccagctagtagcaggggtcaggcttttcatgtgagtctgtataattctcaagcccattgcaaggggcatgtttggagagaggtcagaggctcgcagggttggtatgtatcattggcatgaagggagtgttggagacaaggccagtgaggcaggtagggccaaaccacccaggacctcaaatgccaggcagaggggctaaggctgtccttgagaggcagcagaggaccagggtccgttatgtggataaaaaagactctctggccaagcgtgaaggctcatgcctattatcacagcaccttggaagactaaggaaggaggttcgcttgagcccaggagtttgagaccagcctgggcagcatagtgagaccccatgtctataaaaaattagctgggtatggtactgtgcgcctgtagtcccagctactcgggaggctgaggcaggaggatcgcttgagcctgggaggtctcaaagctgaagtgagctgtgatggcgccactgcactccagactgggtgacagacgaagaccctgtctcaaaaaacaaaaacagactctctgggagtgggtgggggcagagtggagaggagagaagagactgcagtgatggtgtttgggggtgccgaagcttgagctatagctggggccaggaggacagtcggggaggctcagcagagagtcaggaggctggacgtgggacatgaagcttgggggctgatggcctgtgagatgggaggagcaggaagggacaaggacagtacctgcgggtctgccttattgattgggtggacagaggggccattcctgagatgaggacgtagggaagatgggtttgagggctagatgctgagttgagtatggaacacggtgagtctgaagggacaaggtggggccagggtcgagtgcccaggtgacaaatggtgccagattaaggcggaatataaagcaaggtattattattattattatttttatttttttattttttttgagatggagtcttgctctgtcgtccaggctggagtgcagtggcacgatcttggctcactacaagctccacctcccaggttcatgccatcctcctgcctcagcctcctgagtagctggcactacaggcgcccgccaccatgcccggctaattttttgtatatttagtagagatggggtttcactgtgttaaccagggtggtctcgatctcttgacctcatgatccacccatctcggcctcccaaagtgctgggattacaggtgtgagccactgtgcccggcctattattattatttttgcaacagagtttcgctctgttgcccaggctggagtgcaatggcgtgatcttggctcactgcaacctccacctcccgggttcaagcgattttcctgcctcagcctcccaagtagctgggattacaggcatgagccaccacgcccagctaattttgtatttttagcagagacgaggtttctccatgttggtcaggctggtctcgaactcctgacctcaggtgattcgcccacctcggcctcccaaggtgttgggattacaggcatgagccacagcatccagcctattattattatttgagacggagtctccctttctcacccaggctggaatgcagtgacgtgatctcggctcactgcaacctccacctcccgggttcaagcgattctcctgctcagcctcccaagtagctgggactacagacgcatgccaccatgcccagctaattttttgtattttagtagagatggggtttcaccgtgttacccaggctggtctcgaactcctgagctcaggcgatccgcccatcttggcctcccaaagtgctgggattacaggcgtgagccacggcgcccggcctgtaaagcaagatattatgaacaattttgtttccttcttttgaaactgtggggaaagtaggagagcttcatagaatcgtagaaagtcgtggaaaagtccgctctgaatggacgtctgggttttgaaagagcacagaaagccatgaggtcctagacatgttactgcctttctgggcctctgtttcctcaagcacagccttggaggttacactggccaagctgtagtgtcgccacagcgtggaacttcttcccacagttactgtaattgattacagtgctatgaagggggtgccactatttcccatttaatagatgaggaaactgaggctcccaaggttcaatggcttgcctgaagtcactcagttggtactggtggaccggggactggaacccacgtctgcctgccccagagcctattgctcacctccactacatgagattatctctttctgtggtaccagtttttggagcaaccaaaatgagatgaatttgttttggagatagatatggagcaagtggaggcagaaggaaacctaactccatgtcacgacaaatgcccttcaggacttttcatgcccctgttgactgcacatgtttggatccactacatagctggatcaaatttttaagggtttctggttctctcttgctgtttcagtgacctccagggtctctcggagtccctctcctgttctcattttctgctgttgtcacctctttcccttcacaatataccccaagtttcagaaatcagagtgactcacgtttgtcatcatctgctgtgtgtgtgtgtgtgtgtgtgtgtgtgtgtgtgtgtgtgtgtgtgtgttgcacccgggcctttgcttctgctgtgcctgctgctttgaacgcccttttcgcaccttaggggcatacctcccagtcctggtggtctttcaaagtgctacctcaacacccattctctgggagctctcttgggccactctatacctctgtgaccatatcctcctctgggccctaatcatattatatgcctatagatgcctccttagacacccctccaccctgccttccattatggcctgtccagccttccctttaatcgcccatccatctctgattgtccgtctgccccatcttgtttcctctctccccatccatccgtctgtccatctatccatctatccaccctgtacatccatctatccatccatccgttcattcatccatctctttatcctttcatccatccatttatccatcccatccatccatccttctatctgtccatccatccatcctaatcatattatatgcctacctctgagggcaccaagcaccctgagggtagttatgtgttggggggacatatttcccccaatagaaccagcttcttcagggtaggaactgtatctgatttctctctccatccctcccactgcttggtccataacatacctcaataaatattaaatgaataagtgattccttttgtttcttcttgggggctgtaaaccagtggtctgtgctctggccctgagccaaatgaccttatgcctatgatagcctgactgctttaagacccccacactctgcccagtagcaacccctttatgcagagtttaaaagtcagacatgcaaaatagaggcaaaatagacattcagcagatgtccctcctcccctgacttcttgtcccctctccctctaatccttccagcctgtgggagctcggaggcctcagcctacctggatgagctgcgtttggctgtggcttggaaccgcgtggacattgcccagagtgaactctttcggggggacatccaatggcgggtgaggggtcagggcctgggggttgggcatactgacaaagggactgtgctgtcctccctctctgccttctttttttttttttttttttttgacggagtctcactctgtcacccagcctggagtgcagaggtgtgatcccagctcactgcaagctccgccacctgggttcacgccattctcctgcctcagcctcccgagtagctgggactacaggcgcccgccaccacacccagctaatttttttgtatttttagtagagacggggtttcactatgttagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggggcccccccgcgcgggaaggacctgggggcgggattacatcagggatggggcgtggccaaaccagaggcagggctggtggtggccagtgttggggaggggctggtcctcaccacccctccttttgctggcagatgtatctgctctcggacaaggccacctcgccgctctcgctggatgctggcctcgggcaggccccctggagcgacctgcttctttgggcactgttgctgaacagggcacagatggccatgtacttctgggagatggtgagtgctgacttggcgctcctgcatccctgtcctttaggccactggatgccagtgttcccgaaacaattaccatacaattccccgacccctgacgtcacctgacaggcgccccatcctccgtcgctgatatatgcctccaactgcttcctctttcttttctctctctcacatcatgcattattttatgtgtttattttttgagacagagtctcgctctgtcgcccaggctgcagtgcagtggcgcaatcttggcttactgcaccctcagtctcccgggttcaagtaattctcctgcctcagcctccggagtagctgggattacaggcacctgcccccacgcctggctaatttttgttttgttttgttttgttttagtagagatggggtttcaccatgttggccaggctggactcctgacctcaagtgatccacccgcctcggcttcccaaaatgctgggattacaggcatgtgccaccgtgcctggccaagattctctctttgttttggcctttgataatatatctcagtgtggatctctgtgaatttctttttctttttcttttttttttttttttgagatggagtcctgctctgttgcccaggctggagtgcagtggcatgatctcggctcactgcaagctccaccttctgggttcatgccattctcctgcctcagcctcccgagtagctgggactacaggcgcccgccaccacgcccagctaattttttgtatttttagtagagatggggtttcaccgtggtcttgatctcctgaccttgtgatctgtctgccttggcctcccgaagtgctgggattacaggcgtgagccactgtgcttggcctgtgaatttcttttacttggagttccttgagcttcctggatgtgtagacttttgtctttcatcacattttggaagtttttaggacattatatcttcaaatattatttctttccctttctgtctctcttttccttttggactctcattatgtatgtattaatattctgtatggtgtctcgcaagtcccttaggctctgcttattttccttcatttgtttttcttttttctcctcaggctggataatctcaatgtacttagcttcaaattcactgatctttattttgccttttttatgaatctactgttgagtccctctagtggtttttatatttcagttattgtgctttttagcttcagagtttctatttggttcatttctgtctctgtagtcttttttttttttttttttttttttttgagacagagtctcgctcagtcgcccaggctggagtgcagtggctcaatctccgctcactgcaagctctgcctcctgggttcacgccattctcctgcctccacgccattctcctgcctcagcctcccaagtagctgggactacaggtgcccgccaccacgcccagctaatttttttgtatttttttagagacagggtttcactgtgttagccaggatggttgcgatctcctgacctcgtgatctgccctcctcggcctcccaaagtgctgggattacaggcgtgagccactgcgcccggcctctgtagtctgtcttttttttttcctggtcccactacaaaactttatttttgattacagtaccattctcaatctcttctacaaaaagcagaaaaaaaagcagccacttcactcaagacctatatacagataagatgttttctgtgtttttttcttttttttttaatttttatttttaaaaaaataaattcagtgttcacatttctataaagaattaacccagtttcaggaaaccctgcctctatctctgtattcttattctctaggtggtgagacatctttttcctggctccctttagttcttttttcatgatttcctttagctcttcgagcatatttaagacaatttatttaaagcctttgctagtaagttcagtgtctgagtttcctcagggatagtttctattcatttatttttttcctactcatttctattcatttcatttcttttcttttatttatttatttgttgttcttgttgttgttgttgagacagagtctcattctgtcactcagactggactgcagtggtttgaccaaagttcactgcaaccttgacttcttggactcaagcaatcctcccacctcagcctcctgagtagttgggtctaccagccacatgccaagctaattttaaaaaatttgcagagatggggtcttactatgttgcccaggttggtcttgaattcttgggctcaagcaatcctcctgcctgggcctcccaaagtgctgggattacaggtgtgagccaccatgcctggtctctattaatttcttttttttccagtatatgaaccatattgtcttgtttctttgcatgcctcataatttttggttgaaaagtggaacattttgaatatgataatgtggcaactctggaaatcagcttatgccctccctccagggtttgttgtggctgctgctcattgtgggtcattgttgtttgtttagtgacttttcttttttctttttcttttttttggggggaggggggatggagtctcactctgtggcccaggctagagtacagtggtgcaatctcggctcactgcaagctccacctcccaggtttaagtgattctcctgcctcagcctcccaagtagctgggattacaggtgtgtgccaccacacccagctaatttttgtatttttcatagagacggggtttcaccatgttagccaggctggtctcaaactcctgacctcaggtgatccacccaccttggcctcccaaagtgttaggattacaggcgtgagccaccgcgcccaccctgtttagtgacttctctaaaccttttttggaaagtctgtattctttgcatgtgtggccatggaagcccctcttctgttagcttagtggtctgctggtgacttgacagagatatccttaaatgcctagaaccacagaagcaaatataacaagaaactccctataagtgctgggattagaggcatgagcgacgcccaccgtggctgtatattgaagcagtctttcaatacttagccaagctgtttacagttctgctttagtcttcacttcctgcttgtgcagagcctaaagttcagccagatgtaagagcttcaggttttctctggtattttctgagcacgcctctagccctagtcatgcatctagccgtctggatttcctggtacacaaggaagactttcaaagcccttattccctccaagtatttcctttcatggcctctttcttcccaagatgcttagtgtatctattactgcctctactgtgagtccttgcctcagatggatgtggttaattcatttgcctttaaaagattttaacaggccgggtgcagtggctcacacctgtaatcccagcactttgggaggccgaggcaggtggatcgcctgaggtcaggagttcgagaccagcctgaccaacatggagaaaccctatctctactaaaagcacaaaaaattagcctggcatggtggcgcatatctgtaattccagctactcgggaggctgaggcaggagaattgcttgaacctcggaggcagaggttgtggtgggctgagattgcagcattgcactccagcctgggcaacaagagtgaaactccgtctcaaaaaaaaaaaaaaagattttaacacacactgcctggaaagccactttttctctggggaaagctctaaggcaggtgaagcaaagtcaagtccttgagctgttgcttcagggagccaccagatagggccacacacacaaccacaattctggagggtaagtctgaattgctccctctagtactagcgacccacaccaggaatgtgtgtctttgtcttcaaggttgccactgaactggggagctgggggtagtaagtgggtaggttaaaatgtcacagtaccctcttactgaaatttagtggtctcttcattaagcattttcttgtttttttttttttataagttttcgattagattccagaattctagaaaagttgattctgacaacttttgatagctattgattgcttttgtggagggataaagttttgaagttccctacactggcatttttggtcacctctccaagggcttttaaaaatttcattgttagagacagggtcttcctcagtcatccaggctggagtgcagtggcatgatcatggctcactgcagcctcaacctactgggctcattcgatcctcctacctcagcttccctagtagctgggactacagaagcagaccaccacgcctggctaactaaaaaaaaaaaaattttgtagagatggagtctcaccatgttgcctggctggtcttgaattcctgggctcaagcaatcctcctcatttgtaaccacccaatgggttcacgttgcccgctgcctagacagagccgatttatcaaaacaaggaaagtgtaatggagaaagagtaattcgcgcagagccggctgtgcgggagacctcagttttattatcactcaaatcagtctcctcgaggattcagggatcagagcttttaaagataatttggtgggtagaggcttgggaagtggggagtgctgattggtcaggttggagatggaatcacaggggttggaagtgaggtttttcttgctgttttctgttcctgggtgggatggcagaactggttgagccagactacagtctgggtggtgtcagctgatccatccagtgcagggtctgcaaactatctcaagcactcatcttaggtgttacagtaatgatgttatccccaggagcaattgggggagccagaggctgcgtgacccctaaacttaatttctaatcttgtagctaatttgttagtcctgcaaaggtagactggtccccaggcaagatgggggtctttggggaaagggctattatcaatttcgtttcagagtcaaaccatgaacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctcttctctctcagaaaggctgctcttcccataagaagccccgctcccttccaccaaaagccaaccttcccacggcaaagcccatcttcctaaaaagttccactccagatagagaaactccttgtgaccctgtcaggaaattccacctttaaccttggaagtccttcccgctttcagggaagagtccatttctttcaaaggaagtcctagctcatccacaggaagtcctacggcatccacaggaagtcctttccacttcctttagaggtccctagtttcagttttcagcagttagaatggcctcactgaacaattacctttttttttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttgggatgactttaggagaccacctctctgtccctctgccatgtctccgggtgaagaagtttgagttttgctggagaatgcctctccaccttctcttcccctcatttcttgctctgtgcttccccccttgctaggaaatcagaagaggagcccacacgggaggagctagagtttgacatggatagtgtcattaatggggaagggcctgtcgggtgagtggagcctccagcactgtgtgaggtggggacaccctgggcagttcaggacatgtgccagttccacgttgtgttagtcccctcttgagttgctacaaagttgctaaacctgagactgagtaatttataaagaaaagaggtttcattggctcatggttctgcaggttgtacaggaagcatagtgctggcatctgcggctggtgagccctcaggaagcttccactcatggcagaaagtgagggaggagccagtgtatcacatggcgagagcagaagcaggagtaggggtgccacatagatctcatgtgaactaactgagcaaaaagtctccaaagggatggtgctgagccatttgtgaaggacccaccaccaggacccaaacacttcccccaggccccacctccaacattagggattacatttctttgttctttttttctttttttttgatacggagtctccctcagttgcccaggctggagtgcagtggtacaatcttggctcactgcagcctctgtttcctgggttcctgatcagcctgcctcagcctcccaagtaggtgggagtagaagtgcatgccactacgcccagctaatttttgtatctttaaagtagagtcgggatttcaccatgttggccaggctggtgtcaacctcctgacctcaagtgatccgcgcactttggcctcccaaagtgctgggattacaggtgtgagccaccgggcccagccagggattacatttctttctttcttttttgaaatggggtctcgctctgtcgaccaggctggagtgcagtggtgtgatctccgcctcctgggttcaagcgattctcctgcctcagcctcccgaatagctgggactacaggagcccaccaccacacctggctaacttttgtacttttagtagtgacagggtttcatcacattggccaggctggtcttgaactcctgaccttgtgatccgcccgcctcagcctcccaaagtactgggattacaggcatgagccaccatgcctggcccagggattacatttcaatgtgagatttggaagggacaaacatccaaactatatcacacgtcccatcagggactgagatactgaggaagcttcccaggtgccaagctcaagacttggctcaagatttggttctgccatcaaggaggccatcaccagaaattgattttcttcatgctacacatacttccatccctctgtagcaagcggaatcagttgattgagggatttttcacctattttgttcgtggtcccaaggcccctgcttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaattaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaacctgcacatgtacctctgaactaaaaataaacgtcaaaaaataaaaaaaagaacaaaatatgtatcaagagagaagggaaaaactaagataaacatttggaccactgagaaaggttgatagaaggccccagtgtctgaggtcaggatcagtaatggtgtccttccctagcaatttctcatctgcacatgtgatgatgatgacgaccttgataacagctgatgttatgaaacacgtacaatgagcaactactgtgctcaattcttttgaaaatcagttggttttttttttttttttttgagatggagtcttactctgtcgcccaggctggagtgcagtggcatgatctcggctcactgcaagctcctcctcccgggttcacaccattctcctgcctcagcctcctgagtagctgggactacaggtgcccgccaccacgcccggctaatttttttgtatttttagtagagctggggtttccccgtgttagccaggatggtctcgatctcctgacctcgtgatctgcccgcctcggcctcccaaagtgctgggattacaagcatgagccaccgcacccgtccggaaatcagttcgtttaattccaacaacccagtgcaatagggcctataattattctcattttgcaggtgaaataatggagtcattcagtcacttgcctcagatcatgtggttggtaaatggtagagccgagatttgatcccagatcctcttgtacctgagtctgtgctctcagcccctgtggagcccccccactgagagctctgttgaaggacagatcccaagatccccccagagaggctggggctgagcccaggaacctgcctgtggcctggctggaggtgattcaagatggcagatgtgggggaagctttctgacccaccgctctcccttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatctgtcacctaggctggagtgtagtggcaagttctcagctcactgcaacctccacttcccactcccccatacccagttaattttttgtatttgtagtagagatagggtttcaccatgttggccttgaactcttgacctcaagtgattggcccacctcagcctcccaaagtgttgggattacaggtgtgagccatcgcgcccagccaactttgttttttattgtggtaaaattatataaaattttccatttttacttctttttttttttttttttttttgacggagtctcgctgtgtcacccaggctagagtgcagtggcacgatctcacaatctcagctcactacaagctccgccacccgggttcacgccattctcctacctcagcctcctgagtagctgggactacaggtgcccgccaccacgcccagctaatttttttgtatttttagtagagacggagtttcaccgtgttaacccggatggtctcaatctcctgacctcgtgatccacccgccttggcctcccaaagtgctaggattacaggcgtgagccaccgcgccccgcctttttttgagatggagtctcgctctgtcgcccaggctggagtgcaatggtgcaatctcagcttactgcaacctccacctcccaggttcaagcgattctcctgcctcagcctcccaagtagctaggactacaggcgtgcgccaccacacctggctaattttttgtatttttagtagagatggggtttcaccgtgttagccaggatggtttcgatctcctgaccttgtgatccgcccgccttggcctcccagagtgctgggattactgacatgagccaccgcggccggagttgatttttaccatttttaagtgtacaagtcagtgacattaattacatttacagtactctccaaccatcaccactatctattttcaatacgttctatcacccagaacagaaagtgtgtccccatgaaacagcaactccccacttcccctccccacaggtcttagtaacctccagtgtattttctgtctctatggatttagtctagatgtttcatgtaagtggaattatgcgatatttgtcttttggtgtctggctgattttactgagcatgttttcaaggctcatccctgttgtagtgtgcatcagaacttcattcattccgttttatgaatgagtaatattctattgtacaaatagaccacatttgggcccagcgtggtggctcatgcctgtaatcccagcactttgggaggcctaggcgggtggatcacctgaggtcaggagttcgagaccagcctggccaacgtggcaggaccccctttttactaaaaatacaaaaattagctgggctcatgtctgtaattccagctacttgggaggctcaggcacgagagtcgcttgaacccaggaggcggaggctacagtgagccaagatcgtgccactgcactccagcctgggcaacagagcgagactccatctcaaaaaaagaagaccacatttgatttacccgctcatctgttgatgaacacttgggttctttctgccttttggctattgtgactaatgtttgttggaacattggcatgcaagtatctatttgaatccttgtttttatttcctttgggtgtgtatctcaaagtggaattcctcggtcatgtggtaattctatgtatagctttttgagaaaccaccaaactggtttccacagcagctgcaccattttccattctcaccagcagtgtatgagggttttaatttctccacatcctagccaacacttgttattttccttttgtaaaaattatagtcatccagctgggtgtagtggctcatgcctgtaatcccagcactttggggggctgaggtgggaggattgcttgagcacaagagttcgagaccagcctgggcaacatagcgaggctgctgtctctaccaaaacaccagaaatgagataccacttcacacctgcagcctcaacctcctgggctcaagtgatcctcccacctcagcctcccaagtagctgggactacagttacgtgccaccatacctggcttgtttttttaattttttttttacttttattttatttatttatttttagtagaaacggggtttcaccatgttatccaggatggtctcgatctcctgaccttgtgatccacccatctcggctggatcccaaagtgctgggattacaggcgtgagccaccgtgcccagcggctattttttttttttttaatgaaactcctttttaatcctatgttaggtctctctgtttgcttcctttcttgttggcatgatttttgctgagaaaatataaaatttcattggctttggttgtttttttttttttttttttttcagagatggggtcttactatattgcccaggctgatcttgaacccctgggctcaagcagtcctcttgccttggccttccaaagtgctgggattataggcacaagcccctgtgctggacctattgtattagtttcctagggccgccagagtaccaaaaactgtgtggctttaaatcacagaaattgtctcacaattctggatgctagaggtccaaaatcaaggcatccgtcaagctgttttcttctgagggatgtcggggagagtctgttccatgcccctcctgtcacgtctagtgctttgctggccatctttggcttctagttgcgtcattgaaacttctgctttcatcttccagatttccccttttaataaaacgttacttaaattggattagggaccatgctaataacttcattttaacttgatcacatgtgtaaactctatttccgaataaagccacatatttcataaataaaaaatttaaaaaggtctcattctgaggcactatgggttatgacttcaacttttttttttttttttttttttttttggagacagagtcttgctctgtcacccaggttggagtgcaatggcgtgatctcggctcactgcaacctccacctcctgggttcaagggattctcctgcctcagcctcccgagtagctgggattacaggtgcctgccactatacacagctaatttttgtatttttagtagggacggggtttcaccatgttgcccaggccgatctcaaactcctgacctcaggtgatgcacctgcctcggcctcccaaagtgctgggattacagccgtgagccactggacccggccggacttcaacatatctttagcgggatacaattcaatgcatgacactcatagatttatgagtttatttctggactttcaattctattccactggattgcgtctatccttatgccagaaccacacagttttttgggttttttttgagacggagtctcgctcttgtcacccaggcgggattgcagtggcacgatctctgctcactgcaacatccgcatcctggattcaaacgattctcctaactcagcctcctgagtagctgggattacaggcacctgccaccacgcccggctaatttttttgtatttttggtagagacagggtttcaccatgttggccaggctagtcttgaactcctgacctcaggtgatctgcctcggctttccaaggtgctgggattacaggcgtgagccaccatgtctagcccacacagtgttgattactgtaggtttgtagcaaattttgacattggaagtatgagtctcctttgttatttttcaagattgttttggctattctgggcctcctgcaattctatatgaacttaaagatcagagtttccatgtctgtcaaaaaggttgttggaattttctttttttttccttttttttttttcttttttttgagacagagtttcactcttgttgcccaggctggagtgcaatggcgcgatctcagctcaccacaacctctgcctcccgggctcaagcgattctcctgcctcagcctcctgagtagctgggcttataggcatgtgccaccacgcccggctaattttgtatttttagtagagacagggtttctccatgttggtcaggctggtctcgaactcccgacctcaggtgatccacccgccttggcctcccaaagttctgggattacaggtgtgagccaccgcgcccggccagttgttggaattttccgagggattgcgttgaatctgtagattgcttcgggtagtattgatatttcatctaggtgttctttttaatgcttttccagcagtatttggtagttttcaggctacaaattgttcacccttttggttaactttattcctaggtgcttaacctttagatactgttgtaagtggaattgctttcttaatttcctttttggattgttcattgcgggtgtgtagaaacacaactgatttttgtgtgatcttgtaccctgcaactttgctgaatctgcagccctagaagctttcttgtgattctctggcatttcctatatataggatcatgtcatctgtgaatagagatatttttacttcttcctttccaatttggatgccttttattttttttcttgtttaattgttctagccagaacttccagcacaatgtggaatagcagtggtaaaagtggacatccttgtcttgtccctgatcttaggcagaaagctttcactctttcaccattgggtatgacggtagctgtgggtttttcagaagtaccttttctcatgttgagaaagtttatttctattcctagtttacgatttttaaaaattatgatgcatggtggcttgtgcctgcaatcacaatactttagggagccaaagtgggaggatcacttgaggccaggagttcaagaccgacctgggcaacatagtgagaccttatctcaataaaaaaataaaaaatttgccaggcgtggtggtgcatgcctgtagtcccagctactcaagaggctgaggtgggaggaaggcttgagcccaggaggtcaaggctgtggcttcagtgagccatgatttcaccaccatcatgattgtgccaccaacagagtgaaaccttgtctcaaaaaaaaaaaaaaaaaaaaaaagccatgcatggtggctcaagcctgcaatcccagcactttgggaggccgaggtgggcagatcatgaggtcaggagatcgagaccatcctggctaacacggttgtaggggccagccctacaaggtctgtgggtttttctccccgtgtgcagagacaagagattgtagaaatgaagacacaagacaaagagatcaaagaaaagacagctgggcctgggggaccactaccaccaagacgtggagaccgacagtggcccctaatgcctggctgcgctgttatttattggatacaaagcaaaaggggcagggtaaagagtgtgagtcatctccaatgattgataaggtcacgtgagtcacatgtccactggacaggggcccttccctgttaggtagccaaggcggagagagagaggacagcttacatcattatttcttctatgctcttttaagaaagatcaaagactttaatactttaatactttcactaattttgctactgctatctagagggcagagccagctgtacagagtggaacatgaaagtgaaacaggagtgtgaccgctgaagcacagcatcacagggagacggttaggcccctggataactgcgggcgggcctgacatcagtcaggccctccacaagaggtggtggagcagtcttctctaaactcccccggggaaagggagactccctttcccggtctgctaagtagtgggtgcttttccttggcactgacgctacctctagaccacggtccgcttggtaacgggaatcttcccagatgctggcgttaccgctagaccaaggagccctctggtggccctgtccaggaataacagaaggctcacactctgtcttctggtcacttctcatcatgccccttcagctcctatctctgtatggcttggtttttcctaggttatgattgtaaagcaaggattattataatattgaaataaagagtaattgctacaaactaatgattgatattcatatataatcatatctatgatctatatctagtataactcttgttattttatatgttttattacactggaacagcttgtgccctcggtctcttgccttggcacctgggtggcttgccgcccacacatggtgaaaccccatctttactaaaaatacaaaaagttagctgagcgtggtggtgggtgcctgtagtcccagctactcaggaggctgaggcaagagaatggcatgaacccaggaggcggagcttgcagtgagccgagattgtgccactgcactccagcctgtgggacagagcaagactccatcaaaaaaaaaaaaaaaaaatcgtgaagtgttgttgaattttgtcaaatgccttttctgtgttggttgagaagatcatatggcttcccccacaccttgttctattaatttggtgtttgcattaatttttgtatgtttaactacccttactttcctaggataaatcccatttcgttatggtataaaatccacttaatgtgctgctgaattagatttgcttgtattttttcaggatgtttacatgtatattcataagggctactgctctgtaattttcttgtgatatctttatctggctttggtattacggtaatgctggcctcatagaatgagttaggaaatgttctctccttttcaatcttttggacgaatttgagaaacatccttgttattataattcttctttaaatatttgatagaattcaccagcacagccatctggttttgggcttttctttattgaaacgtttttgattcaatctcttatgataattctactgagattttctgttttttcttgagtcagcttagctaatttgtgtgttcctaggaatttgtccatttcatttatctagtttgttgacatataattgttgatagtattctcatacaatcctttttatttcggtaaggtcagtagtaatgtctccattttcatttctgatgttagttatttgtgtccaggctaactttggagcccaactttaacctgacttcaacctccaccttataccgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtg

SEQ ID NO: 986 - DNA, 54084 bp, Homo sapiens; identical to SEQ ID NO: 985

SEQ ID NO: 987 - DNA, 55258 bp, Homo sapiens
agtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccggtgagccctgtcctggcctcgcgcgcagcacaccggaccggcgctaggcctccgcgtaggcctggcctgcacgggcgggcacccggcatggactgggaggggccggggtggggtgcgcggggccggcggcgcggagatgacccaggcaccgtcccctctcccggctgggtcggagccctgcgtggcaggggagcgccgtccccctgagccaccgatgggtggggggagtggagatggggaagcctctcaaagtcgtgactctgcagaatagtttctgacgctgccctggtgtgcggtgaaagtgagggtgtgtcctggggcgctgggccaggctggaggtgcagggagattcctttgggcttctcagtggtcgccgtggaagggagcggggaagaaggggagggatggagcgacccttcttggggttgccaagcggcgttcgccgcccttcgtcgtccttcgcccttctcttgccccttgcctttgttcgaccgcccctttggtaccagttttagttttgtcccgaggcagattgtaaacctttttgcttcgttttcgtttcatcaaacgttgcattggatttctgtatccgaaacgtggtgtgagctttcagaagtagatgaatacacatatccccggggtgtcatttcttgattggcgtttgacaggggcttgtattgtttgcttgctgacagtccagggtactggccagggatcacttttacttagggaatggaccttgctgctccctagccttattcaaaatggcacctaaaatatgtgtggtgtctccaattggctgtaggtgtgtgattcgttgaccatccctgtttattctgttacagttcctttattgaagattcagcatttacaaagcatgatacgaatcaagagtattgtttgatctcaaggtggattcttgatggtctagaatcttgaatcgaattcttaatgattgcccaacccctttctaaagccataacaacagtagaatggctcttgaaatattctaatacttaaacacaccagtagattcacacacataaaacaaaacccctctgtttcctcaaaatgccagcgctgaccagagtttcttttttaaaatttgagctttatcttaaatatttaatcagatcttttcctcatcccccaaatgaaggaactcaagtagatttctaaggtcccttcctttgacctctccatattgagaatctgtattttgagggtcagcaaaaagctctatattaaaatgaagagaacattttaagtactatttcataagatttagtagaaaattaagtatctagtctgagcgcggtggctcacgcctgtaatcccagctctttgggaggctcgaggcgggcggatcacttgaggtcaggagttcgagaccgcctggccaacatgttgaaaccctgtctctactaaaaatacaaaaaatcagtcgagagtggtggcaggtgccggtaatcccagctactggggaggctgaggcaggagaatcgcttgaacctgtgaagcggaggttgtagtgagccaagatcgcgccattgcacttcagtctgggtgaaaaaagcgaaactgggtctcaagaaaagaaaaaaagaaaattacatatctagattattaaatggttaaggataagtgcagttaaaaattaaagccaggggccatgatgtatgcttttaatcccagctactcgggaagctgagttgggaggatcacttgagccaaggagttagagggtgctgtgatctgtgatcacgccactgcactccagcctgggtgacagagcaagacccccgtctctaaaaataaacacacacctgtgcctcttatagagttagggttttgtacatattgctttgttttaatcttcaacgtaatcctgtgatactggtataattcctcttgtaagcatgagcaaaaagttttaagtaacttgctcatggcaatagcacaataaatttcaggtaggttcctctcctttacttctagtactgttttggtttaatcctgtagcatctttagcttgtactattgtaatatgcttctagtttattttagtgattacagtatgccttcttcaagcctgatttctctgctgctgcaagtgatctaatagtattcaaaccagactaaagtggcctttatgacagcctttcaggaattacacattgcctacaacataaagcctttacgtattttattttatttttttttattttttgagaccaagttttgctcttgttgcccagtctggagtgcaatggcgcgatgttggctcactgcgacctccacctcctggtttcaagcgattctcctgcctcagtctcgcgagtagctggaattacaggcgcctgccaccatgcctagctcatttttgtatttttagtagaaacgaggtttcaccgtattggccaggctggtctcaaacccctgacctcaggtgatccacctgccttggccttccaaagtgctgggattacaggcatgagccaccattcccggcctctttatgtatgatttaggatgacttatcttccataatttgatccttagccagcttccagtttcatctactgctgctttcccttcactctggtaattaattacttacatcttagaacacaccatgctgctttatgctgtggaatgttttccttcttttctgggaattcttctgtcctctcctagtctctgactaacacctaatcttttcttgagattcaaaattgatagtgataactcagaagttaacacttcatccaggaaatctttcctcatttatgaagcattccactttgttgctgtagcctttgtaatacttacatagttaattactctagcctcctcccacccccccattaggctgtaagtttatggagagtcttcccaatgctttgtaccgggcttgtcattaaatgaatactcaacatattaattgaactgatgatagagttgggatttggtgtctgagtgaggttttcaaattctgatttcaggagttggaaagcaattaacagttgtgaggttcttatttttgagaaggtataaaattttcagtggaaacaatatatatccttgggttttaaaaatatatatttcaaaagttagctattttatgaggctgattgaaattttttattgtggtaaaatatatgtaataaagtttaccattttaatgatttttacgtatacagttctatagcattaaatatattcacagtgttttgtaactgtcaccttcattcacatcctcttgcaaacaccattctctttttgtatgtatgaatttgaccactttaggtatctcatataaccagaatcatccatgttgcagcatgtataagagtttctttcctttttaaggttgaataatattccgttgtatgtatataccacattttctttgtccattaattggttgatggacacttgagttgctcccactttttcggctgttgtgaataatgctgctgtaaacatgggtgtacaaatatctgtttgagtccttgctttctgatcttctgggtatacccagaaatgaaattgctggatcatatggtaattctatgtttacttttattccccccagcagtgtacaagtgttccagtttctccacatctttgctaacacttgttattttctgttaaattttaaaaagaatagccattctaatggctgtgaagtgggatttctatatatttttaaatgatttagatatgtctttggattttttcttaattgagcacctcttgttcagaaatgacacttttcaattctcccagatttcttatgactcagaatctgtattccttaagttgttctagatgtgctttattctcccaggaatttttcttcttctcttaaactatctaacctttctctctctctcttcttttccaatgctgtgtgctgatgtgaatgattcttcaattaaacacatgggggctgcgaaacttatcattttgggaaatatttcaatatgatcatattgttggagtaggattcagaagacttgggagtttattaaccaattttatgacattagcaaatcaatctacttctctgaagtctcagtttctttttttttttttgagatggagtctcgcactgtcgcccaggctggagtgcagtggcgtgatcttggctcactgcaaccttcgcctcccgggttcaagcgattctcctgtctcagcctcctgagtagctgggattacaggcgtgcgccaccacacctggctaatttttgtatttttattagagacaggctggtctcgaactcctgacctcatgatccgcccgcctcgacctcccaaagtactgggattacaggcgtgagccaccacgcccagcctgctgaagtctcagtttctttaactatgaaatgagaagttaggtttgatccagtgaaattttattcagcacctactgcatgcatgctcctcttgattaggtaagtgttatgggcatagaaagatgaatgacatgttttgactcccgataactgcctaattggtgatcttctaagggtctgtaaatcttgtcttgttattttttaattaaaaaaattgtgattttgtttgcagttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggtaaaatgtagtccaaattttcatcacattactattattgtatactttttgaaaaataacgccagaaaattatttaattttaatgtagcatttgaagtgctttttttatatgatgagagtatgtcagctatggtgttaaaactgtcttatgcctgttagagtaagggagaaatattgtagctgtttgacaacactatatggtattataaaaacatcgttttaaaactctttttacttttgtttatttttaacttttaggttctgagatacatatgcaggtttgttatataggtaaacttgtgtcacagggtttcaatgtacggatttcatcacccaggtactaagcatagtacccgataggtagtttttttttttttttagatcctcttcctcctcccactctccaccctcaagtaagttccagtgtcttttgttcctgtctatgtgtctatgtgttctcattatttagctcccacttacaaaagagaacatgcagtttgcttttctgttcctgcattagtttactagggaactagcaggtaatgatctccagctccatccatgttgctgtaaaggacatgactttgttctaaaagcatcatttaaattttattttaaaatgtgttgtattaccagatacctctgtgggtcaggagagtggaacactttacagttatctgtattgtgtgaattttttttcctatgaggatgtattaaaagtattagttttattttgtttagactaaaatgaaaccaattaatatttccttagtaattttctgtaatgaggttggaaaattttatctcagtttaaaaatgtggaacaatacagataggtttgttttcttaaaaaaactactacagaatgtaattttgtacatgcatttgtatgttgaaattcaaagcacttcagcatttttaccaaagccctggttctggaaaactgttcattttttttttttggcctttattgcatcctacccattaacgaagagctgtttttctttttctttttttttgagacgagtcttgccctgttgcccatgctggagtgcagtggtgctatcttggctcactgcaacctccgcctcctgggttcaagcgattcttatgcctcagcctcctgagtagctgggattacaggtgtctaccaccatgcccggctaatttttgtatttttagtagagatggggtttcaccatgttggccagtttggtcttgaactcctgacctcaagtgatctgcccaccttggcctcccagagagctgggattacaggcgtgagccactgcacccagcccccttttttctaaacagtaattgttacctaactcctacctggagatgggaggaaaaaatttttgtttaaaaagagaagaaacctaatttttgtctttacttcctttggaatgatctcagtgaccacagttaagaatccatccctgccagcatcattgatgaaggactgcagaaaagacaagaagatatctattattattattattttttttgggattgagtctccctctgtcactcaggggctggagtgcagtggcgccatctcggctaactgcaaccaccgcctcccgggctcaagtgactgtcctgcctcagtctcccgaatagctgggataacaggtcaccaccaccatgcgtgacaaatgtttgtatttttggtagagacagtgtttcaccatgttggcgctggtctcgaactcctgacctcaagtgatatgcctgcctcgggcctcccaaagtgctgggattacaggcgtgagccaccacacccggcctctattatttttaataatataagtatagctttaaaaaatacttccttcaagggttagataaaatgctaaagatctatagttaactttagagataaagacaggctacccccactgggcagtaaaacacacgttggaggaaaatctttgtttacccccgaaggtacagtatgaacctttggcctttagtgaacttcatagcctaatctatgctgaacactgtactagtggtatgctgtcgagaattatagaagtatgcgaattaaatgaaactgtgactgctaatggttaccatttattgagtacttattttatgtcaggcttttattatattttctttaattctcagctgtatgttatccatatcttatatatgaggaaattttataaatgagtgtcaaagaggtttaagtaacatagtaaggcaccaaaagagcatatgatttatacatcaagcagatctgtgttcacttcccagttttgtgtgaccttgggtaagtgatcttagggggcatttatagttatcattcattatgtttagcagtcatagaccttaaattgagaagggcctttaggaagttaccgttccattttaaagcagataaaagagataattagtggcaccaatgaagggtagacaagcatattgggtacccgataccttctataaaagggagtaatatagaatcgactttatcctatgaggggaaaggcctagctgtagttagtaaaaatattactctggactaatcatgcatttaaaaaaaaaattcttgatttttattcaacatattgaaaggaaagtatatacttgctttatagatgcgttatagacattaactcttcattcttgccacgtaagcttgttatttattagctctgctggttccaaacatccaaaaaataggatctatcatttgtcattagtcaagtgttttttagtacttgctaaaagtatttttttatacttatgtgttttttagtatttgatgctgtaaatacaggttactgccttttgtattgtgttaccttatgcagttgaagcaaattatttgaaaccctggctttagtaccacttgtgtttaaaaaaaatttttgtttttttttgagatggagccttgttctgttgcccaggctggagtgcagtggtgagatctcggctcactgtaacctctgcctcctgggttcaagcaattatcttgtctcagcctcccgagtagctggaattacaggtgtgcaccaccatgctcagctactttttgtatttttagtagagatggagtttctttatattggtccggctggtttcgaactcctgaccgcaggtgatttgcctgcctcagcctcccaaagtgctgggattacaggcgtgagccactgtgcctggccaaaaaaaatttttttaattgccataattttaaataaaatctgcatataggataaattttattctgttttgaagtacattaaaataaattgattattagattgtgttcagcttgtacagtggtggttaaatgtcttttgtttgtctttgaaacaggatgatgattggggaaacatcaaaataaaaaatgtaagtattatcttatgaacgtttattataatgcagtaacctcattatgataccaaaatacattccagatgactttttttcatgtgtatatccagttgttccagcactatctgttgaaaatacttaccttttcccattgacttgtgttgggctctttcttgaaaagtagttataggtttgtttttgggtttttgtttcattgatctagtagattaaagttacactagtaccaaatggttttgattactaaagctttataataaaagccttgaaaaaaaaattagctgggtgtggtggtgcacgcctgtaatcctagctactcgggaggctgaggtgggaggctgaggcgggaggcagaggcaggaggcaggagaatcacttgaacctgggaggcggagattgcagtgagccgagatcgtgccactgcactccagcctggcaacagagcgagactccgtctccaaaaaaagagtcttgaaataagatagtatatgttcttatgctctccaactttctcctctttgagattttgtttgagattacattgaatctgtagctcaatttggggagaataaacatcttaacaatattgagtattaaaatccctgaatatgatgtacttccttatttatttaggtctctgtttttctcttagcagagttgtagtttttaaacatagaggttttgcatgagtggttttttttttgagacagggtctcactctcacgtatgccggagcacagtggcatggtcatggctcgctgcagctttaaactcccagcctcaagcagtccttccatctcagccttccaagtagctgggaccacaggcgggtgttaccatgcccagttaattaattaattttaattattttttgtagagatgggggtgtcactatgttgcccaggctggtcttgaactccagggctcaagcgatcctcctgccttggcctcccaaagtgctgggattaacaggtgtgagtcactgtgcccagcccttgcatgacttctcttaaattattggaacttaacatttgttcgctgcttaaaataatattaaaaaatatttccagtgttcatggctagaatgtaaaaatacaattgatttttctctcttttttttttttttttttttgagacagagtctcactcttattgcccaggctagagtgcaatggcgcgatctcggctcgctgcaacctctgcctcccgggttaaagcaattctcttgcctgagctgggattacaggcgcccaccaccacgcccagctaacttttgtatttttagtagagatggggtttctccatgttggtcaggctggtctcgaactcccgacctcaggtgatccgcccaccttggcctcccagagtgctaggattacaggcgtgagccaccgcacccggccaaaatacagttgatttttctaagtttattttcattctttattcttgtaagcaattcacttactaattccagttgtgttttgggcagattccattgggttttctgtgtacataaacgtgttatctgcaaataatgacaattttacttctcccttttcaatattcgtgactttcagatttcttaaactttattgacatataattgataagcaaatgacttcttttttttgagacagagtcttgctttgtcgcccaggctggagtgtggtggtgtgatcttggctcactgcattatttgcctcctgggttcatgtgattctcctgcctcaacctcctgagtagttgggattacaaacgcctaccaccatgcctggctaatttttgtatttttggtagagacagggtttcgcaacgttggccaggctggtctcgaactcctgacctcaagtgatctgcctgccttgatctcccaaagtgctggaattacaggcgtgagccactgtgccaggccttgtcctactttttaataggacttctaatacagtgttaatagaaagtgataagagtggccgggcgcggtggctcacgcctgtaatcccagcactttgggaggccgaggcgggtggatcacgaagtcggagatcgagaccatcctggctaacatggtgaaactccgtctctactaaaaaaaaaatacaaaacaattagccgtgcatggtggcaggtgcctgtagtcccagctactcaggaggctgaggcaggagaatggcatgagcctgggaggcagaggttgcagtgagctgaaattgtgccactgtactctagcctgggcaacagagcgagactccatctcaaaaaaaaaaaagtgataagagtggacatcttggctgggtgtggtggctcacacctgtaatcccagcactttgggaggccaaggatggtggatcacttaaggtcaggagttcgagaccagcctggccaacatggtgaaaccccgtctctattaaaaatacaaaaattagccgagtgtcatggtgcacgccaagagaattgcttgactttgggaggcggaggttgcagtgagctgagatcacaccactgcactccaacctgggcaacagagcaagactctacctcaaaaaaaaaaaaaaaaaaaaaagagtggacatcttgtcttattctagttcactacaacttaaaattatgaaagaccgttacattttgttaagtgttttttctgtttgttaaaatgatggtgtgatttttttttctttttttctgttggtagtgtggttaatctcattgatttttaacttaaaccgtgcatttctgggatgtgcagttctcaaatttcttggttttgtgacccttttgccctcttaaatattatgattgaccccagagtttcatataaaggcacacctcattttattgtgcttcacagataattgtgatttttataagttgaaggtttgtggccaccttgcatcgagcaagtttataggcaccatttttccagcagcctatgttcacttcatgtctctttgtcacattttggtgattcttgcaatatttgaaacattttcattactctcatgtcaagtatgttgatctttgatgttacttttgtaattgttttggggtgtcatgaatcacacctgtaagatggcaaacttaatcgacaaatgtgtcttctgacagcctcaccgacccgcagttccctcctccctcttctcgagcctccctattccctgagacaagacagtattgaaattaggccaattaataaccctacaggctgagcgcggtggctcacacctgtaatcctagcactttgggaggctgaggcgggtggattcctgagttcaggagttcaagatcagcctggccaatatggtgaaaccccatctccactaaataaaaatagaaaaatagccgggcgtagtggcacatgcctgtaatcccagctattcgggaggctgaggcaggagaattgcttgagcctgggagatggaggttgcagtgagctgagatcatgccactgcactccagcctggccaacagagcgagactctgtctcaaaaataaacaaataaataaataaataaataaccctacagtgacctctaagtgttcaagagaaaggaagagtttcatgtcttttactttcaacagaaagctagaaatgattaagcttagtaaagaaggcctgtgtaaagccaagacagtccaaaagctaggcattttgcagcagttaaccaagttgtgaatacaaaggtccagttttcaaaggaaatttataatttaaaagataagttcttgaagtgttactgcaatgaacacacaagtgataaagcaaagcagccttattgctgatatggagtaagtttaagtggtgtggatagaagatcaaactagccacaacattttcttaagtcaaaacctaaccagagcaagaccctaattctctttaattctgtgaaggctgagagaggtgaggaagctacattgtcctcatcagactaacacaggaacagaaaaccgaacaccgcatgttgtcacttgtaagtgggagccgagcaatgagaatacatggacacagggaggagaacagcacacacgggggcctgtcaggcagtgggatgtggggagagcatcaggataaatagctaatgcatgctgggcttaatacctaggtgatgggtctataggtgcagcaaaccaccatgacacaatgtttacctgtgtaacaagcatgcacatcctggacatgtaccctggaacttaaaaaaaaaaaaaaaaatatatatatatatatatatatatatatataaactgaagctagcagaagttggttcacgaggtttaaagaaagaagcaatctctgtaacataaaagtgcaaggtgaaacagtaagtgctgatggagaagctgcagtaagttatccagaagatctagctaagattgttgatgaaggtagctacactatacaacagattttcagtgtggatgaagcagcctgatattggaaaaagatgctgtctaagcctttcatagctagagaggagaagtcagtgcctgggttcaaaggccagactgactgtcttgttagaggctaatgtagctaatgactttaagttgaaaccaatgctcgtttaccattccaaaaaccatggatctcttaagaatgatgctaaatctactctgcctgtgctctgtatatggaacaacaaagcccagatgccagtacgtctgtttatagtatggagtactgaatattttaaggccaccattgagacttcctgctcagaaagattcctttcaaaatattactgcttattgacaatgcatctagtcacttaagagttttgagagacataaacgagatgaatgttgttttcctgtctgctacaacaactattctgcagcccatggatcagtaatttctacttttattatttaagagatacattttgtaaggctaaagtttccctataaagttatttctccatgaatctgggcaaaatcaattaaaaaccttctggaaaggattcacctgaattcttgataccattaggagcattcatgggaggaagttaaaatgaagtcagtatttaccaggagtttgaaagaagttgattctaaccctcatggatgactttggggagttcaaaacttgagttgaggatacaactgcacatgtggtgtaaataggaagaaactagaattagaagtggccaggcatggtggctcactcctataatcccagcactttgggagtctgagacaggaggagagcttcaggctgggagtttgagaccagcctgggcaacacagtgagaccctgtctctacaaaaaataaaattagttgggcatggtggtgtatacctgtagtcctagctactctggagactgaggcagtaggatcgcttaagcctaggagtttgaggttacagtgagctatgattgtgccactgcactccaatctgagtgacagagtgagaccctgtatctaaaaaacgaaaaagaatagaaaaatggagcttgaaattgtgactgaattgccacaatctcatgatacaacttgaacagatgaggaggtaacttatggatgtgcaaagaaagtaatttcttgagatagactctactcctagtgaagaagctgtgaatgttgttgaaatgacaataaaggatttaaaatattacgtaggcttacttgataaagcagcagcaggatttgagaggtttgactccagtttcgaaagaagtcctactgtggataaaatgctattaaacagcaccgcaagctacagagaactctttcatgaaaggaagtcagtcagcgtggcaggtttcattgttgtctcattttaagcaattacccagccttcaggaaccagtgccgtgatcagtcagtagtcatcaacttggaaacaagaccccccacctgcaagaagatcattaactgaaggcttagatgattgtcagcttttttttttaagcaataaattattttaaaattaaggtatgtgcattcctttttagacataatgctgttgcatacttcacagactgatataaacatgatgtttgtatgcactgggggaaaatttttgtgtgacttgctttattgcgatatttgctttctcatgctctggaacccaaactgtaatatcttcaaggtatccctgtgttttaatctatgtaatactcttttgttggatagaagataattttatctaagtcagttgatcacattttttagtgatttgtactatgttgtaagaaatcttcgcctgtgccaagtttacaagattttttttttctgttttcttgtaaagcttgataagttttagctgttacatttagatatattgtctgtctttttttttttttttctttgagacggagtctcaccctgttgcccaggctggagtgcagtggcacgatctcggctcactgcaagctccacctcctggttcacgccattctcctgcctcagcctcccgagtagctgggactacaggtgcctgccaccacacccggctattttttttgtattttttttagtagagacggggtttcaccatgttagccaggatggtctctatctcctgacctcgtgatcagcccgccttggcctcccaaagtgctgggattacaggcttgagccaccatgcccggcctatattgtctgtttttttgagacggagttccgttcttgttgcccaggctggagtgcaatggcgtgatctcagctcaccgcaacctccgtctcccaggttcaagagattctcctgcctcagcctcctgagtagctgggattaaaggcatgcaccaccacacccagctaattgtttgtattttttttagtatgttgttggtcagactggtctccatgttggtcaggctggtcttgaactcctgacctcaggtgatccgcccacctcggcctcccaaagtgctgggattacaggtgtgagccaccgcacccggtctattatctgttttgagtaaattcttgtgtttgctgttaagcaatggttgaggttatttttttcacatgagtatttagtgagcaacatttgttgaaaagactattcttttccattcttcctcagtgcctttgttgaaaatcagttgaccataaacataagggtttatttctggattctgttttcttccattgatttttatatgtacctttgtaccagtacccattccctgctgttttgattcttcaggccttgaaatcaggtcgtctaagtcttccagttgtttttcttttttaaagttgcgttggctattctgggaactttgtacatctattgcacatttttagattctgcttgtcattttctccataagagtctgctgggattttgattggaattgcattgaatctgtatgtcagtctgggacatctcaatattgagtcttctaacttacaaacatggtaaacctttcctttatttaaatgttcaatgttgggacttacacatattttgttccacatattgttaagtatttcacgtttttctttctttttttttttttttttgagacagtcttgctctgacgcccaggctggagtgcagtggcgtgatctcagctcactgcagactccgcctcctggcttcaagtgattctccttcctcagcctcctgagtaactgggattataggcacttgccaccatgtctgactaatttttgtatttttagtagagacggggtgtcaccatgttggtcaggctggtctcaaactcctgacttagagtgatccacctgccttggcctccccaagtgctgggattataggtgtaagccactgcacccggcttatttcatggtttttaatgttgtcgtaagtggtacttttctttctttttttttttttttttaaagacgaggtcttgctttgtcggctggagtgcagtggcacaatcatagctcgctgcagccttgaattctggggctcaaggggttctcccacctcaccctcctgagtagttgggactataggcatgcaccattgtgcttggctaattttttgtttttgtttttgagacagagtcttgctctgttgcttgcctaggctggagtgcagtgacgtgatcatggctcactgtagtttctgcctcccaggttcaagcagttctcgtgcctcagcctcccgagtagctgggactacaggaatgtgccaccacgccggactaatttttgtgtttttagtagagatggggttttgccatgttggccaggctgttctcgaactggtctcaagcaatccttctgccttgagctcccaaagtgctgggattacaagcgtgagccactgcacccagctgtggtgtttttgaaatgtcattttccaattgcttgctagtatataaaaataaagttaatttttataattgactttgtatcctgtgactttatttcatatattaatttcttaggatattgttaggtatacatgtcatctgcaaataaggacagttttatttcttcctttttaatctttgtgcattttgtttctctttttttctttattgcaatgcttaagactttaaacaatgctgagtagaagtggttgatagtggacatcattgcctttttcctgaccttaggggaaaagcctccagtcatggctggtggtagtttatagatgttcatcatcaggttcaggaactctttctagtttgctgagaggttttgtcacgaatggaagttgaattttgtcattttgttaaatgccttttctatatcatttcttcctctcattttatccattaaactacacagacttttgagtattaaacagaacttatattcttgggataaaccccacttggacattatatattgctagattctatttgcttatcttttgttaaggttttttgtgtctcttttcataagagataatggtttgtagttttcttgtattcttttttatctggttttgctatcagtgtaatgttagtcttatacagtgagttaggaagcatcccctcttttctgagtttgtattaatattttttcttccttttttatttctgctcccactccactgggatattttttctttaaatgttgcctaaaattctctagtgaagcctagttcactagacttcatgtgggtttggagttttctttgtaggaagactttaagaatttagtgtctttaataaatgtaggactatttagatattatgttttctttcctatcagtttgataatcagtatttcttaaggaattggttcatttaagttgctgaattgattgtcatattctactgttattaccctttaactctagaatgtgtagtgctgctttttcgttttcctctctagtattggcaaattatgatttgtctgtttcctctatcatcaagccagagttttgtcagtttcattgattgtgtccccccaaaaaaaaaacatttggcctgttcatttattacttcgtttattttttctctttgctttctttctttctacttcggttttaaattttttaaaattttgaaaatttttatataatcatattttgttgaatgaagtgctgaaacccaggcaaatggtggtgacttttttggtttgttttagagatggggtcttgctatgttgctgaggctgaccttgagcacctaggctcaagcagtactcccaccttagccttccgactaccttggactacaggtgtgtgccaccacacatggcttggttttaatttttactttttctagcttaaggtagaagcttacctagttcattaattttaagcctttttttaaatctcttttgctcatttttgtagtatgtatttgctttttcttatagatttgcttttttgagtgcttagtatatatggtatagttttgcccctagtttattgttttcaaatgttttatagacatttttaagatttgtgtagctagttacatcaattgttaatatttatgtcagttttagaaaatcttccaacaatgcatgagttttttgattcacttgcattcttttatgaatattaatttttttacatttaaatctttaattaattgttgttgtggtatggtatgaagtagagagctgatagtatgttttttctaaagtatacagtttttctcaatatttttcattgtataatcccttttcctaataattttttaagggcattgttttagtctctattctttttcagaaatttcttagctattatcctgggtataaatttgctgcatgaatgaatcattttgcaaggttttgtaaaggaatttcattaaatttatataactataattgcatctttatagtaatttttcaagtccagagcttgtcatgtcttccagtttatttaggtgctttttttaaaaatatccttaagtaaagctttattctctcattaaagtattacatttttcttgttatgcttattcttagatatatgttggcatttcttctattgtgttttccaactggttattgctagtgtattctttaaatagttggctcttgagacagttgtctttggaaaaagattcttggcctggtggggtggcttatacttgcagtcccagcactttgggaggctgagatggggggatcacttgaggccagaagtgtgaggctacagtgacctataattgtgccactgcactcctgcctgggtgacagagtgagtccctgtctctaaaaaaaaaaaaaaaaaaaaaattctgtagtgatggcttagtactgctttactgctttgcaatgatcttataaaatgtctatgtagaaataaaaggtgatagaataaaggtcattaaatttaattgtaggtattcttaactgaactaatttcctaattttaatcatcatctggatatttttagtcttctggctatcatttttccctccctgtttttttttttttttaaatctccacttctggtcctaccttttactttgtctcatgtgttcatgccttccaattaagatactgagtaagagagtaagatgttattcatattttaagattatgagctttacaatgacagtgtcttccttgtctttctattgattgtatggagtgtttgcatatgtattaaataaaagtatttacttaggttaatgtgtagaattatataattggatattttgaacaaatttactctgtatttggtttgatattttttagtaatagagaatttaatgctctaaaaatatttgtatttaaatgtaaacaatcactacagttacacaatagacattcacagaaataattttattagtgtttgtttgtttgtttgtttgttatattttttgagacggggtctccctctgtcgcgcaggctggaatgcaagtggtgtgatcacagctcaccacagcctcaacctcccaggctccagtgatcctcccattttagcccccaagtagctgggactacaggcatgcacccctatgcccagctaatattggtattttttgtagagatgggatttcgccatgttgcccaggctagtcttgaactggactccaaccatccactagccttggcctcccaaagtgctaggattacagcatgagccaccatgcctggtctgaattttattagttgtaagtttgttatggagagagataatgccactaaatgttaatgatcatttgaggaattccctctgcttcaatattgtaaacattattaggtgtttttatggcaatacttattttttccttaagctttattcaggtacaatttatatagagtaaaattcacctgtgtttgatgtacagtttgatgactttgggcgattctatattgtcatgtaaccactaccacaatcacgatttagaagtttcatcacgaaaaagtttctttgtacacctttgccttggcctcaaacagccaccccagtgctttttacttgttttaaacaatgcagtgatttttagtagtgtatttacagagttgtgcagccttcaccacagtctaattttagagcatttccattaccccagaaagaaacttgtaccatttaaggtcactccctctccccatctccagtcctaggcagcaactaatctactttctgcagatttactttttttggcaaatagaattatgttatatgtgttcttttgttcctggcttcttttggtttgacataaacattaccaacttttaaggattttcatgaaattactttttttaaaaacagggaatgactctactaatgatggggtcagcagatgctcttccagaagaaccctcagccaaaactgtcttcgtagaagacatgacagaagaacagttagcatctgctgtaagacacaccagattttatgtgtttgatcactactttttgaaggaccattattaaggtgtctttcagaaagtagcatctgaatgtcttgaagacttaatcattaataccaagatagatatttttagcagtaaataagagttttattatttttgattagcttaagggagtccttctgtagttaaataaggcacagctaggggtttttttttgtattgtacaccttactactggttttcagacttccaagtgaatttacttaggcttaacttacatatatttagctaatatctgtaataaatatgttcctggcagatagtactatataagtatttactattactattttatgagaaaacagggtcaaagagtagtttaaatgttgggatatttaaatttttaaaatccttcatgtggaaaatacatacattttatcctgaatttaaatgcaaaatcagtttagaaactggtcaacacgtgtcaattttttttttaacacctagcatttatttagtgccattcattcattttcatggtttttttttttgctttttttttttttttccttgagatggggtcttgctctgtcaccccggctggagtgcagtggtatgatcatagctcactgtaacctcaacttcctgggttcaagtgatcctcccacctcaggctcctgagtagcgaaaattgtaggcgtgcaccatcatgcccagcaaataaaaaaaaaaatttttttttttttttgtagagatggggtcttgccgtgttgcctaggctgatcttgaacttctgacctcaagcagtccttccacctcagccttccaaagtgctgggattacaggtgtgagccactgtgcccaacctgttattttgctttttgttttgaagtgtttctttgcatattttgcctattctcttctcttgataaacctgcaaaaaaggcaagactagtatgattattctcttattatatttaagaaggaaactaaaacataatatgatggccagcatgatccaagtaaacttttttttgggggaaataaaactgtttctttagcgtgaaggcagaatataaattggtagaagctagtaaatggtacttgattcaaaatgagaattttagtgatttatatatgccatgtcattttgtaaaaatggtttaatgatttaatccttttttttttttttttccaactagatggagttaccatgtggattgacaaaccttggtaacacttgttacatgaatgccacagttcagtgtattcgttctgtgcctgaactcaaagatgcccttaaaaggtaagactgcagtcttttttgggtaagggatgttcacatttggatgagtagtattgttttgttttgctttctttagcatcttaattgagatataattaatttattatacaattcagcattttaaagtgtttaatgctttttatagtatttacaagtttgtgcaaccatcaccaccatcgattttaggacattttccgccccctccaaaagcagtgtcgtactcactggcagtcactcctttaaccccttcacccacctctagccctagccaaccgttcatctactttctgtcatagatttgctcattctgggcatttcatgtaaattgaatcgtataatatgtggcctttttgcggctaacttctttcatttggcatgttcccatggttcattcaggttacagcacacgtaacacctcattcctattttatggctgaatagtatttcatggttcactcacgttacagcacacgtaacacctcattcctattttatggctgaatagtatttcatggttcattcacgttacagcacacgtaacacctcattcctattttatggctgaatagtatttcatggttcactcacgttacagcacacgtaacacctcattcctattttatggctgaatagtatttcatggttcattcatgttacagcacacgtaacacctcattcctattttatggctgaatagtatttcatggttcattcatgttacagcacacgtaacacctcattcctattttatggctgaatagtatttcattttatggatatatcacattttatttatccattcattttgttgatggaaatttgaattgtttctcctttttggctgttatgagtaatgctgcagtgaacattcatgttttttgtgtagatgaacgttttcatatagtaactctatgtttaatgttttgaggaactgccacaatgattttccaaagtgacggtaccattttacattctcaccagcaatgtgagaaaattgccaatattgtctgtctttgattaagccatctagcgctatgaagtgtggtatctcattgtggttgtcatgcacattttttttagtggctaatgatgttgggcatcttttcatgtgcttattggccatttgtatatcttctttggagaaatgtctgtttaaatcttttgcctgtgttttaattgggttatttgtctgtttaaaaattcaattgtgtttttacatatatacaagttccttacccaatggataatttgcaaatcttttcttctatactataagctgtcattttactttcttttttaaaatttatttttttcctaagtctgttgtatgcagtctccttttacttttcttgatggtacgtttgtaatgcaaatgttttttaattttgatgtagtttaatcttaattttaattttttcttttatcacatatgcttttggtttcatatgtaaaagccattgtctaattctaggttacaaagacttacttctttgttgtttttcaagagttaatatacttttagctcttctattcaggcctgtggttaatttttatgtatggtgggagggagggaggtatttgcctattattttgcatgtgtatatccagttcttccagtatcatttgttgaaggctattgtttccccactgaattgtcttagcaccttttttgaaagtcagttgaccttaatgtataggttcatttctggaccctggattcttttccatttatatatatgtctatccttatgtcagtcagtactggtttcaaaaaagaaagaacattttgtttttataccatcgtatgaaaggaaaagagtaaagaattaattacaaatgttttgagaacctgtaaaatggtctacaaataagggccctttcttccggtgagtataagtgtaacttaaaaaatatgtaacttaattctgactaaatttatacaactgtcttgatacataaattgtcagttctttatgatagaattctgaactacaatttggattctagacagctttatgaatattgatttttgttttttcccctcagtctattgtgaaatgttgtgatagaactgagcagaagagaagggagagaaggagtgtgcaaaaatctgaaagagtgactttaaaggttttctacatttctctgaagcgaatagttgtcaggtatttatgagaaattgcatagattgcagctgatatattatcagtgaacaagacacagtatctgtcttcaaggcacctacagtctaatagagaaagactatcaagtaaacaggtactgtttcagaactgctttgatgggaaatgtaggctgctatgagaacatctaagggagttcatcaggggtatctgaggatagtttgggaagacttcttagagtaactggtatttaaacagttaggtgttatcccagcctggatgagaggttagggaagtgtgagagtggactggaggaaagagtttttaagcaacagtctggaggcaggagactgcaacatactcagtgcaactgcctggagaaggatggatgtagaaacggtgatagatgggagattagcaggggccagccagaaatcttgaagtcgtttttaagaagtgtggacttcgtgttgtgggcgaagagaaaccattggaagattttaagcagagtactgacattcaaattatcctctgaattctaggtagctaagattattattttattcttcaacagtttttattttaattttgcttaaaaaattgcctggtgaatcttactgtgtcttttatatatatcccaaaatattgctttattttaccctttcctcttatccttggatgataatattgcttggagcaagagtctaggtcaaagccatttttcctcagtgattggtagttatttgtccactatttttgtgtgtccatgcttactgatgagaggtctgatatcagtcttgatttttattcttttctgttagtagcttttagggttttctcttttttttttttctttcccccagttttccaagaatgtgagactgtgggttttatttatcttataaaagtactcagtgagcacttttagtctgaggactcttgtcgcaaactctaggacatttcttggtcattatttctttaggtactgcttctcctccacctggtttcttatacatattaaaatttctagatctgttttttagtcttctaactttcctccgtgttttaaatttttataatttttatgtgatgtgctctaggaaaatgcctcagttctgtcttacattttactgattcatacgtctactttgtttcactgcttacttatcatgaccttctgttcttttttataactccttattcttaatttttggatctaaatcctgcttttatttttctgaggctctgaagtatttttatttaaaggttttttttttttttccttgttgtttggccttttaactctgttctttttggatgtaagggttgttcttccctcatttgtttaaaggttgtgtgctcatatcatgcaaccatattctcttccttatgtcccagttgcaaattatctgaataggtagtttgctggggtagctttctggctagcacccttgggagtggctgatggagatagccttggctcacttccaagatttcctctttactgttttcttcttggatgccttttagcctctgttcctgagagagtgctcttttatgttttggaaagagttctgtgtaagcaggggagatttcatcctatgtggttctattttcctgaaaccaaaagaagtattttttgtttttcctttttttaaaaaaataaaagtgaaagttacttttttcgctttttggtttttatttttagtattttttcttttttttgtacagcaacctctgatgccaaacaaaagaagtagtttttgaattctaaattttctcaagagagtgcacttactaacgtaattgatacaagatgtcatggatggtggtatgtctttggaaaaatggcactaactgataaaacaagaatgaaagaacagaaaaacattccacgagaggtgttttacagctggagatgaggaagaccatcctcacaaatacttagcagaacttgtctttggcaggttctatagagtgggaggtatgggtcccgagtgtgatggctcacgcctgtaatcccagtactttgggaggccgaggcaggtatctcacttgagcttaggaatttgagactagcctcggcaacgtggcaaaaccccacctctacaaaacagacaaacaaacaaaaaaccaaaaattagccaggcatggtggtgtgtgcctgtagtcccagctactcagaggctgaggtgggagattgcttgagcctgggaggtcgagtctgcagtgagccatcagtgtgccactgcactccaggctgggtaatagagtgaggccctgtctcaaaaaataaaataaaataaaaagagagtgggatgtataatgatggagggtagaaggaaagtgtgttcaagagaaatagactggattagcttaagaggcagtaaggatcaagaactatagccacaggtgaaaataaggtttgaaatggcttgcttaatgccgcccaacagtggaatcccatcatactcctggagttagattctcaatttagaacctagagtgaaaactatatgttataaaaaaatcatcctaaaattctataaattactcctcaaaagacagtatcacatggccgtatctgttgtattggagactggcaagccccagctctcaatatacacagcgttaacagttactaggttgctgattttctttcattttttttttcttattttttatttatttattttcgagacagagtctcactccctcacccaggctgcagtgcagtggtgcgatctcagctcactgcagcctctgcctcccggcttgagcaattcttctgtctcagcctcccaagtagctggaattacaggtgtgtgccaccatgcctgactaatttttgtatttttagtagagacgggttttgctatattgtcaaggctggtttcaaaatcctcacaagtcatctgcccgcctcagcctcccaaagtgctgggattacaggtgtgagccactgtgcctggctgaaaatatttgtctgttaacactagcgtctcattcagttcagtgagatgctcatattatgagaggcatgcaagaactgagacactcggagagaacagaaaagccccatatctcatctcacagctgtctaggggatatgttcattgagtggaattgcatgtgggattgcttacactacttaaattattttcttttttttagctttttgagggcatgtcttcatttaaaatttaaaaaaattttaaattattttttattttttgagacaggccctcgctctgttgcccaggctctggagtggcacgatcacagatcactgcagccttgacctcttgggctcaaggatcctcctgacttggcttcccgagcagctgggacctcaggcatgcaccactatgcccagctgattttttttttttttttttttaagtagagacaagagatggctatgttgctcaggctggtttcaaactcctggcctcaatcaatcctcccagctcagtctgccaaaatactgggattacaggtgtgagccaccacatctggcacacatatcttcattctaagtaacagatttcaacttgttcttgacaaaaaaattttaaataacagaaaagtctacatatttgatattcactttttctcagccatcttctcggcccttatgtcaggatatgatgaaaatgcatcatacatttaattcatacagattgaagatgtgccctgggctggatgtgatggctcatgcctgtgatcccagtgctttgggaggctgaatctatagcttgaggccagaagtttaagaccagcctgggcaacatagtgagacccgcatctctgcaataaaaaagaaatagctgagtgtggtggtgtgcacctgtagttccagctactcatgaggctgagctgggaggaatgcttgagctcaggagtttgcaactgcagtgagctgtgatgatgccactgcactccagcctgggcaatgcaatgagaccctgcctcttaaaaaaagagatgggccaggagcagtggctcatgcttgtaatcccagcactttgggaggctgaggcgggcagatcaccgaaggtcaggagttcaagaccagcttggctaacatggtgaaaccccgtctctattaaaaatacaaaaattagccaggtttggtggcaggcgcctataatcccagctactcgggaggctgaggcaggtgggtcgcttgaacccgggagcagaggctgcagtgagccgagattgcaccactgcactccagcctgggtgacagagggagactgtgtctcaaaaaaaaaagagaaagggatgaagatttgcgttatatttgggttttttctttaaacatatgtgtagcagtgtatgtgtttttttataaccaattcaaacagtcttaaatttgtgctcatgtctttgtttttatgcttacatattaacaattctgcagtacatcttgatgcataggattctttggatcaatttctggaagtggagttagtgggttaataaattagagtggatagtttgacctttcagatattggcagttgttatcccaaaaggtagaaaaatatgaatgctacattctgtacatattcatcaatgtaaaatattataatgataaatattttttgactactggtaagattgaactactgtttactcgtgagtttattggtgacttacatttctaaggtaaaaatctaggtttctcttttttctcccatcaccatttattgtatattgatacacattgatcttttatcatatgtattattattaaatatttttgagacctgttcctagattttctaactgggtttatttattgaggtctgattttcgatatgtgtttgtattatgccattttaaccatctggtgtgtagtaatgcatacttcttactttcagtgtattactggatagtttgatccatattttacatatctttgaacttcatagtcatgttcaatacgcctttctccctctaaatggatatatagtgggagtgtcagcctttgggattttgaccataatggctttaagtttgggataaattgacatttttgcaatatttagcttccccatccaggaatataggctgtctccccattgtttcaggtcttatttgactttcagtaagatggatttttttcacgtgttttatttccaactgttttgaatttttgtattttgtaatgttagatgaattttcccttgatcattttgttattggccctgctagctgatgggaagaaatcaggagtactaatttcaaatatcagatttccatggttccaagatatactttcccctaatattgaaatagtccttatattctatgaaaattttaatgtagtttttatttaccttgaaaacacatttatttaccctgaaaacacattttagttatgatgatatttatgattatgatttatgatatatttatgaggaaataaggcatattttctattagtatttggattttctaaatagataatcaaatccattactcaggttatttttgtctgtttcaggtagtttacttcatgtttctttcgtgcttcactggctagaacttttaacacaatgttaaatagtagatggttgtggaattctctcttgtttttgattttaataggactgttgtattttagggttaaatattgatcttgggtttggtggaaatgttctttttttcttttttctttttttctccttgtcttcttcccctcaggtttggtggaaatattcttaagaatgttaagaaagtatccctccatttgtttactggaggttttttaaaaataagaaatacatgttaaaattatcaaatgttgtttgttgacctagtactaagatttttctcactggatctatttgtgatacattatgttaatagttagcctaatagtagactatattcctgatacattcgtattctttcaatatatagcgctgaatttaatttgctggaacattttaaaaggattttttggggtcatttgttagtaagactgatttatagcattctgtctccctctggcttttttttttttttttttcctttgtgagggtttggtgttacagttatgctagctctatgtctatcttttcctggaacttttattttctttcatgtttttataggactgatctgttgttgaaagccttgcccatgaaattgtctgcactcagcttttttggggtattttattttattttattttattttgagacagagtctcgctgtgttgcccaggctggagtgcagtggcatgatctcggctcactgcaacctccgcctcctgggttcgagcgattctcctgcctcagcctcccaagtagctgggattacaggcacccgccactatgcccagctaattttttgtatttttagtagagacgtggtttcaccatgttggccaggatggtcttgaactcctgacctcaggtgatcccccggctttggcctcccaaagtgctgggattacaggcgtgagccaccgtgcttggcctttggggtattttaaatgtacttattctcttctaaagtcagttttggtaatttatattttcctacaaaattgtcctgtctttaaattatttcagcttaagagttattctactattggacctgtatggttttttttttgtatttttatttcttatttgttatatttgtgttttcctcccttgattttcttgctagagatttgtattttagttttcaaagaattggctattagatttgttcattcaattttttgagttgtctgattcatcctacttttgtttgtattaattttttcttatttctgtttaccttaggcttgttttattgtctattttctaacttaaaagtttcatatgtggattgtttacttacccttgtgtagtaatgaaagcatttagttctgagattttgcttgttctctatttgttagatgaggctgttcaaatgttgacaaaagccactagaaagtctcttatcttttccttttagctcagttttgtttgttttttctttgttttttttttgagaaggagtctcactctgcctccagactggagtgcagtggcacaatctcggctcactgcagcctccgcctcctgggttcaagtgattctcctaccacagcctcctgagtagctgggactacaggcgcgtgtcacaacgcccagctagtttttgtatttttattagagacagggtttcatcatgttggccaggatggtctcgatctcttgacctcgtgatccacctgcctcggcctcccaagtgctgggattacaggcaagagccaccatgcctggcgcgtttatttttgattatggaagtataacatgccagagtatacaaattataagtgtacaactcaatgaattgtcccagggtgaacacatccatatacccaaaataaaggcagaacccttctagcactctaaaaatcccctcacagatcttaatcactaacaccgtttatgtttcccaaattggaaatactatcctgacttctaatctcatagatcaattttaccagttttgaactctatgaacagaaatgtacaaattgggcccatttgtctggctgatgactgggtaatgggtctggctcatgatgtttagtgtatccatgttctgtgtattggtggttcgtttatattcatgctatatagtatagtattccgttgtgtcctgtactaccaagttattatccattcttctgttgatgaatatttggtttatgttcagtttttggtgattatgaaaaaatatactctgaatattctagtacatttttgggcacatgcatttgtttctgttgggtatatatgagtatgtatgcatatgcacaaaatatatatgagtgaaactgctgggtcataaaaggatttatatattcagttttagtatgttttgccaaccagtttcaaaaacggaggtaccaattcatattttcattagcattatatgtgctttccatctgttccacatccacccccaagagtttaagccaagttatttagccagtggatttagaaacacatatatgaaagcatatgttataaatgtactttatttcactatgggtaaggattgtggcctacataacttttggtttttggaaatttgagtttgtctttttgatctgatgtatgattgaatatttcatagggactagaaaagtcaaaatgtcctctctttgtaggtgtcaaagtataatagacattaggttaattttattatgttctgattttctatatcattactttttatttattgacttgacagagataaggaaagattctcagtacttttgactgtaaaacctctcagtatttctgtcagtttccttttattttctaagtttttctttataaacttcagtgttaatgttatttggcttaatggatggttttacatgaattaggaattacattttattgctctaatatgggaatttttttttggatattaaattacatatgaccttccttagttacaaaaaaaaggttgataattcattagtatatctttgccataaatgtagaaatagttacatattcatgttaccctataacaagaagtaaaattcagtaacagcagcgattatatagctaattacatacccaagtgatgttcagggtatgtctgctatattagtacttaattttaatttcaaaaatgccttttaagaagttgctaaaatgtcttaacagggaaatgtaatgattttcaggtttttaaaaatgaacacacataattcaggcattattgtgaattattgtgtattgaaaaattaagaaaattcgttgagtcacatcagtttccgaaagatgcaaacaaatgaaaaagggaaaaacaaaatccttcaattgagtacaatttaacacaatactctctgtgatttctttcatactacttaacataagcatagaggttttgctttttaaattgagatataattcacatctagtgaaatgcatatatcttaagtgtttggtttgatcagttttgacaaatgcaaattctctgtaatccatttgcctatcaaagtatagaacatttctatcatctcagaaaatttcttgggcatgccttttctcagttaatccttatcctctccacccccttccagcaactactgatttcatattagtttgcacattctgaaacgtaaaataaacggaatcctacaggtcatgcttttcttttgttctggcttgtttcactcagtatctagcttggagatccattcatattattactgactagatcagtaattctgattgctccacaatcttgccgatattgggtgatactagttttttttaaattttgattttagtcactctaatgggtgtgtagtatgtacacatagtttaatcatagtgtatatgcagtctccctctcacttcagtgtttgatattaactgaatgataatttctgagcttttgtaataagacattgtgtgagtaatgactatggtttgaatagtcatttgaaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatgagtttgacaaagggaaagagcttaaagtaggctccatctaaattcccttttcagcattcctttttttctccatatttctggtcatgcaagaccagaagagaagaaaaggaaaggtgggaacaactctgagaaacttgcagttgagggtgtcataagaactccttttaactggtttcttcccatttgagtgttagaatgaattgaattctattgtttaactcggctttaatgttcctaggtatgcaggtgccttgagagcttcaggggaaatggcttcagcgcagtatattactgcaggtttgtatactaaatatactactttttgataggagtaagacattctatttttcgctcacaatcctttgcagtttacagaatgtcttttgtaaaacatcacctcattaagcctggagtgtacattatacttaagttaaacaacttggtacttattttatcgtccagattataaatcaatgatgtctgtcgtttgtgaaaaataatctttggatttttttggattaaattataattttggcttcaggtttgatttgtataatacatatctttggggttgactctggggatagccagcgacgggttttatcataatccatgtatcattataaaagagggtcttagtgaatattggtgtaaagaagtgatgtgtgtgaggagaaatagtaatcttaaaggatagaaataactggtttcttcattgcataagagaatataacccccacctaattttggacattttaatactgttaaatctttgggttaggtcaatagggttttacagccatgcctttttttttactctctctctaacagctttattgatatagtgtacatatcataaaatctgcccatttaaagtgtataattcattgttttttagtttatccacagagttgtgcaaatattactaaaatgttaattttagaacattatcattccaaaaagcaacttcataacatctagcagtcacctcctttcccatttctagccctacccatttatctatgtgttatttctctctagatttgcctactctggacttttactctaaatggaattaaataatatgtagtctcttgtgactggtgtctttcacttagtataatgttttcaggattcatccacattatggcatgtatcagtacttcattcttttttattgctaaataagagtgccttgtatggacaagccacatatcatttatccattcatcgttggtggatatttgggttgtttctgcttttcgactattacaaatactcctgacagtcgtgtacaagtcttggtgtggacaaatgctttcatttctctttggtatgcatctaggagtggagttaattactgggtcatatgattactatatttaaccttttgaggaactgccagaattttccaaaggagtcccaccgttttacatttcccccagaagggtatgagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaactttttttcctaaagtagacttacttgttgaaatgaagtttttagtgagaaagtgtgatcatttatatctacttcatttgacagctcatgtatcttagaataacttagaatttcagcagcttctgcagcatcatatatgcggctaatagtattgatgcgatgaaaaatactgttctttacatttttgcttcttgattttttaactttttgttttgaaatacatttaaatttacagaaaagttgtaagaattcaccagttactaacttttagtcgcatttggtttctcatttttccgttatgcatgtaatttttttctgaaccattttagaataaggcgccagacatcctgaatatttcagtatgtatttcctaacaataaggacattcataaccacaagacaattcttaattttcagaatctgggctgggtgcggtggctcatgcttgtaatcccagcattttgggaggctgaggcgggcagatcacttaaggccaggggtttgagaccagcctggccaacatggcgaaaccccgtctctactaaaaatgcaaaaattagccgggtgtgttggtgcatgtctgtaatcccagctactcgggaggctgaggcacgagaatcgcttgaacctgggaggcagaggttacagtgagctgagattgtgtcagtgtactccagcctgggcaacagactgagacactgtctcaaaaaacaaacttttttttagaatttgggagtttcacacagtaccctaaaatacagtctttattcagattttgccaactgtcctagtattgtccattaaaaaagttttttttttttccttcttcaggattcagtttaagatcccacattgcatttagttgttatatcttattagtctcttttaatctatatttcttcttgacctttttctttcaaactaatgaaatacttttgagatgctctgttgatggtatatactagatcttaaatcatctgtttttttgagtagtgtataaaatattgttaaaatgtaggcttttatttaaaaaaataattagcttggtagtgatgcccaaatttcagccttccctccaaaaatattttttaaacattgtgttcagttttgttattcaggaacattttattgagcccctgctttgtgctaagatgctgtatttggtgggttcagtctgtataatgatgataggtgacatttcacatcttgggtattaataaaacatacaagttgagataagctagaggaagagttttgctgtacatgaaggagggcaaggtatgatcactaggaagtccgcagaggagaaatggttcgaaatccaagagaacagactagtccatgactgtgagattcatgctgctgagaggggtaagtggaaagaaggttttctgaagaaggtaaattcttagtagttttggttcttagctgtccagtagagtcagctgtttaaggacccagatttaaatctccaggagttgagtagatgagaaccaactataggtttaaagggaggtaagttgggagaggtgacccgctatcctgatcttggcagagtagcagaacaattacattatgcctgtttgtccctaaacagaggttatgtgttctttgtactgaattaaaacaccctgctttgtttgggaagacaaaggctggcaagaagaaagagagagggagggctcagaagttgtttacagctagtgattgctttgtaaggtcttctggtgagttaagatttaaaaaggatttttttttttcttattgagagtccaacaattgtcaaagagtagatacacttaaaaatgtttaagcagctgggtgtggtggctcacacctgtaatcccagcactttgggaggccgaggctggcggatcacaaggtcaggagttcgagaccagcctggccaacatggtgaaaccctgtctctactaaaaaaaatgcaaaaattagccaggcatggtggcatgctcctgtaatcccagctactcgggaggcccttctgtgttcaagcagttctcctgcctcagcctcccgaatagctggggttacaggctgaagtgagcggatcatgaggtcaggagttggagaccagagcctggccagcatggtgaaaccccatctctactaaaaaaaaaaatacaaaaaattagccgggaatggtggcgtgtgcctgtaatcccagctactctggaggctgaggcaggagaattgcttgaacccagaaggcggaggttgcggtgagccgagatcgcgccactgcactccagcctgggcaacggaccaagactccatctcaaaaaaaaaaaaaattaagtaagtttttgtttgtattaattaaaattaatttacagtcgcgtgtattaaatatgtgactgttttactaaggcaatgtttgctttgtctttaagcccttagagatttgtttgattccatggataaaacttcttccagtattccacctattattctactgcagtttttgcacatggctttcccacagtttgccgagaaaggtgaacaaggacagtatcttcaacaggtaattagggcaaggtatttttcattctgtaaatgtaaaacttaggtttcctacatttaccgtacttactggaacatagttcgaaatataaacatcagtcttctctagttcatgccacggctgtctcttgcctggagccgcacagtagtcttaactgatatctggcttctgcctttgcccctttgcagtttctctacacagcccgcaatgtcctttttaaaatgacgataggattatgttggccccttgttcagtactccctagtgattttctaccgcagtcctaaatcctctagcccctggctttctctctgagttcatcactaccactctgtcccttgcttgcctctctccagctgcacaggcttccttaaacctttcaagtgccctcttcctgcagggcctttgctcttgttctttggctgtcagataagtgcaagaccagctccctcacctccttcaggtctcatggctccaaggccaaagccttaggctttccctgatgaccttattggaacagcacacttcccttcccctgatcacttactgtttccatcctgctttttttcgcttcataacccttatctctacttgaattttatatattcactgctattatgctgagtatctagtacagtgtttagcacaaattggagctcagcagatgtctgttgaatgaataagctattctagaatgctttattttttggaagatcgtatgtcttatttggcttaatatttttaaagaaggaaaccactttcttgcctaggagacagtgattattttggaagaactttgtagatcattcactgccaggattacttactttgtctttttttacattacaggatgctaatgaatgttggatacaaatgatgcgagtattgcaacagaaattggaagcaatagaggatgattctgttaaagaggtaattgaaatatatttgtgattatagactttcgttataccttgatttttttttttattttttttcccctcaaaggcttaaaataagttccatcttataggtagatgtgtatttaaatactttagatgctcaatctgtagtcagaatttggaagcttgcatacgacatttaaatttaatgtattatttattaaacttaattcattgttgatttttggtaatgttttttgaaggattttactgtaagggactacatttttaaaaaaatatgtattactaaactggattgtgtggaagaaaatctacattaatatttatataaagttggaatttttattttaatttttgcagacagactcctcatctgcatcggcagcgacaccttctaaaaagaaaagtttaatcgatcagttcttcggtgttgagtttgaaactacgtatccttatgagccaagatatagactatactcataccttattagaattggcataaatagcatcattggctgattgattggtggtgggtagaagaaaaattcttcagaggttttttttctttgagacggagtttcgctcttgtcgcccaggctggattgcaatggtgtgatcttgactcactgcaacctccacctcctgggttcaaacagttctgcctcagcctcccaagtagctgggattacaggtgcatgccaccatacccagctaattttttgtatttttagtagagatggggtttcaccctcttggtcaggctggtattgaactcctgactttagttgatctacccaccttggcctccaggtgtgagccaccgcgcccagcccagaggtttttatacctaaaaaaatacaataatggaaattaggaatttggaaaaatatacctattggagtgatcttgaaggataatgggattattcattatgttttgattaatataattattttaaatttatttcttgaaggatatttattattttttcctaagaacatctttagcagagtctacctcattttcattcaccttataaagaattaatttcttatatgtcaaggtgactgttaataataacttttaaaataaaaaaagaattttttaattttataaaagggtgtgtatcaactatacatgagattgaaccagttaataaaacatgaatcaggaaagtactgtcttctaggtcatggttagaaaaacttagaaacaatttatgtacctttgggcttctaagaccattataagaccatactaaataccagcttatagtttagagtttattgcagtttatcttttaatacacatttattactcattgttgtttctagaattgttggtagccaaatgaacattcttaagtatgttgaaatgaatcttgggagactaaaaggttttaaatgccaatgaatgatactattaattttaatggaattaggataatgtattatattcaagagtatataacaaattgaatacccgttggcatattccttatcttagtttacaaagcatgaaatgtacagaatctgaagaagaagaagtcaccaaaggaaaggaaaatcaacttcagcttagctgttttatcaatcaggaagtcaagtatctttttacaggacttaaattggtaaggacaatctcagtccatccttgttgtttgtgaattccatgtttgcgagtaagccaaagtcattattcactgggctttaatggtcatttgtagacatgtgcagagcaatacgcattttgagttgcccgatacacacagtcccatctgaggtcaaacaagtacttggccttcttgtttcagcttggtaaacaaataccattttagcaggaatgttagaactgttgttttaaaaaaaaatttctgctttttgttggttatttcactgtttaagatgaccccccaagcacagggctgagtgctgtctagtgtttctaggtgtgggaaggctgtgatgtgccttactgagaaaatatacttgttagagaagcttcagttgggcctgcgttgcactgttggctctgagttcaatgttaattaatcaacacaatatgtgaaataaggtgtccttaaacagaaacacacataaaacaaggttatgtattgattggttgatgaaaatgttgtgatcaaaggctggcgggaatctaatcctgtatttcccctaggagcagtggttcagtattcattgattcagtgcttgtggtgactttgtagaacataattaccgtgactaacaaaatcaactgtatagtcagaaatcaaacaaacttcaactagctcttcatttcatagacaaaagcattattgacatggttgcatatgctaacaaatattgggacatctcactttttaatcactgggtgttcctgcttcacactgtgaagaagcacctagtgctttgtgctgtaccttgctttattttaaagcactcaagaaatgtttgttgaatagtttacatgtttgttaagatttttccttagagatagttgttttcatgggccctataacttagctgaactgttaactttaaggaaaattacttaatctaagctactgttttcttacgtgaaaatgagagtaactatagggttgtttgtgggtttgtgctcttaaccattaagggtgatcatataatgtattgtctaaaccaggacactttggtggagagtgaatgagggtatgttagtaattatgcaatataaactgggatttttctgtgcaaatcagggcatgtagtcgttctgccattgcactgtcttgcagttgaggccctggaatttaaagtaacctaattggcttttggcagagccagaactagaacttgcttctttcattattcagttagtgctgcttttccagtgccatactaaagaatacggactcacataaaatgtcagcttccactctgctaataagcccatggataaaacatacggttttgcttgctgacttactaatttggtgtgctttggggatatgtatatctctcgaaggatctccccatttgaactgataccttttaatagttttcaaattatagttcatgtgattccacttcaaaagcactgataattaggattgtttattttattttattttatttatttatttacttattttgagacggagtctctctctgtcacccaagctggagtgcagtggcacaatctcggctcactgcaacctctgactcccaggttcaagagattctcctgccttagcctcctgagtagctgggactacaggtgcgtgccaccacacctggctgatttttggtatttttgatagagacagggttttgtcatgttagcctggatggtctcaatctcctgaccttgtgatccgcccacctcggcctcccaaagtgctgggattataggaatgagccaccgtgcccagccaggattatttattttaaaagttagcttcttcctaaacacagttgtatgaaaaataaatgcatgaataaaagttagccattgcaacatctagatatttgaagaagggcctggagggcagaatttttaaaaatcctggttgatcctctttgctgtctcctctaaccatgaccaataaagagaagtcttgaaggaagaaaagtcagtgaaaaatgatgagacattggaataggtcctctgtgcagaggcctagtttgggcagaggaggtgggttgataaacactgaagtgggacatggattatgttgataaacaagatgatttgttatctgggggctctcatctatagtttgggataaggttggcaaggggaagggttgttaaagggcataagaagaagagtgagtgagtcacgctctgtcttatgataccgaggggagagttttgagccagtgtggatatgaacatggtgacttttaagagaaattcatttaaaaacacacaaaacttcttaacccccaggagccaaatcatgtaaggcatggtgtgcaagtttcaggatataccagcaaatgaagtctcagtgttaactggagagtgtggagtggagtgctttggcagggactctccaggatggtattttcttcacaattttgtaaaagtataggaaaaccgaacatacccagaaggtctagatgatagtggattggtggtaataataagatttcaccagatatactttcttgaaaaacctgtattcctagaatgtatttatttcctttataacttttaagatattttatcttttgttctgataattcttgagtaatttggcttcgtttctccactgctttgctgctgaataaacttggttaaatgttaaaaagctactccacagtgattccttttgtaatatgattagtaattttaaaaaatcagactttaaaattatacaagtgtaacatgcttaaacattaccagtaggttattttaattctaatttcttttttgtttgttttcttaaagcagagcacataagtagtgctaattctttctgtgacattagaaatagtagtgaatgtttgttaaatgtagagtatatgccaaatattttaccaggttttctacatgtactgactgtaattctaacaataacactataacattgattaccactaccaccttttccaaatgatgcccagagggataaataccgtttccactgttacacgggctgtaagaagcagaaaggtgatcatgctggttaagatatgtgcagcagctaaaggctttcccacatctgttaggttaacagaggtttctgtgttatgacttttttcaaatttaacaataattcattggtgctgattggcttttatgcataaaacgtaaagaacaggagtttcttgggctctcttaattttcctctagagtgaatattctgataataaacaggaatgacagctttgttatataaaatacaatataaaattctctgaatctaagcatcatttggggcatagctaaaaaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtatatcaaatctgtaagttatgcagtcctttcgaagccaaattccgcttcactgaaatatttccagttaattaattttatccagtcttaatttttaccaccaaataattaaaacttgtatggtattttgatgtaatgggatttctttacattttgtctcctcagtccaagatcagccggctgcctgcttacttgaccattcagatggttcgatttttttataaagagaaggaatctgtgaatgccaaagttcttaaggttagtaatgaactttactttgtataagaaatgtaattctttgaaggtaattgctaactcacaattgctttcattattcctttaggaatagttaagctttctttgaaatatttaggggagctaatattagacaagtgattcttaactcagaacgtatattagaattatctattgtcttttttatttttaactgtacacacacctggcttctccctcacccccaaacatctgggtaggtcttcggtggggcctaggatattatatttttcaaaagattcatatacaattctgatggctctcctgcactacccagaaatagtgccctagaccacgtcctcagcttcagggatactgattcagtaggcttggagatgggtgtgaggtagggagtgataactctgcactatactctaggtggtttctttctttttttttttgagacggagtctcgctctgtcacccaggctggagtgcagtggcgctatcttggctcactgcaagctctgcctcctgggttcatgccattctccagcctcaacctcccgagtagctgggactacaggcgcccgccaccgtgcccggctaatttttttgtatttttagtagagatggggtttcaccgtggtctcaatctcctgacctcttgatccgcccgctttggcctcccaaagagttcctttctttcaggtgaaaggagaaagagttaaatcactggtgcccaaagagtacttaaattgtaatcccttgatttaggatccagcctcagaatctgactgtttttgttgagttgtagttctgctacatctccatagagtcctgggaggggcctatctatcattttagccttttgagcttaaattcttagtatattttccagtatacttagcgttgtatgagaaggttaaatgtagttgaagtatctagtgttgtatactttaaatatatactactataagctattgaactatatcactattacttctatgtaaagttgtatttcaaataaaaaaaaaaaaccataagtttattccagtttgggaggtccattattttcacagcagcttgtccaatatttctgagatgtttcttttctcaggtaaattttggtacttcctctgtggttagttttgtgggttagagtatttaatggaaaaacatgttttagaaatttctcaccttaaaaaagttagaaccagatcattcttgaaaataggcactcttaagaggtttcaactgcagatttccaagtgattttcacagattttattttcaactgtatctgaattatgaaagcattacttcagatatgtgatactttaaataaatatctttataaatgtgtttacacatgttttttgtttgtttgtatataggatgttaaatttcctcttatgttggatatgtatgaactgtgtacaccagaacttcaagagaaaatggtgtcttttcgatccaaattcaaggatctagaagataaaaaagtgaatcagcagccaaatacagtaggttcttactgctgactttatactcttaatatcttaatctcccatcagtgctcagcaattactctgtcttttttttcctgcttcatttttccttcagaactatactttgtatagtattatttggatcaatctgtattacaattagcaggtatacacatcctccatatatcagtgcagatctttaaagttttgcatgtgttttattttcctttttttttttttgtgacaaggtcttcctttgtcactcaggctcactgcagtctcaacctcccaggcgcaaatgatcctcccacctcaccctcccaagtagctgggaccacaggcgtgcgccaccatgcccagctatttttttgtatttttggtagagacagggttttgccatgttgctgaggctagtctcgaactcctgagctcaggcgatctgcccacctaggcctcccagagtgctggggattataggcatgaggcaccacacctggcctttaggtgtattttagcatgagaaacagaactctacttagaataaatgagtcctttgtggtagaataagcttaatattttccttccccctgtaatctgtagctcatattccttttatacttatctcctcaaagtacttcacgtaaaaccttacctagtgttgaccttgatgcagtcaaaatacagtacatttccatcaccacaaagatcttgcattattgccacagggccacttttcttctgccctaccccttccttaattcctgacaactaccaacccgttcatttctataatttttgtcatttcaagaaagttggccaggcatggtggctcacgctagtaatcccaggactttgggaatctgaggcaggaggatcactttaggccaggagttcgagactgtcctgggcaacgtagtgaaaccctgtctctacaaaatatgaaaataaaaaaaatcagttggatgtggtggcatacaccggtagttctagctacttgggaggctgagatgagaggatcgcttgagaccaagagttaaatgctgtaatgagccatgattgtgccacagcactccaacctgtataacaaagcaagactctgtttctaaaaaaaaattatacaaacgaaataaaaactcttccactttttaatataacctttctcactcagcataattctctggcgactcatccagggtgttgtgcatatcagttgctccttccatttcattgctgatcagtattccctggtgtgaatttaccacaatctgcttcaccattcacctattgaagaacacctgggttgtttctagtgtttgtctgtgatgaataaacctgctgtaaacattcgtgtacaggttttaatgtaaacgtaagttccatttctctggaatgaatgcctaggaatgcagttgttagattgcatggtagttgcatgtttagtttttcaggaaactgccagatgttttctagagtggctgtaccattttacatttccaccagcaaggtgagactgattcactttctctgcattctcaccagcatttggtgttgtcactatttttcatttcagccattggataggtttatagtgatactgtgttttcctttgcaccttcctagtggctgatgaagttgagcatgtcttcatgtgtttatttgctatctgtatatcctcttttgtaaaatgcttcctcttgtcttttccctattttctaattgtactgtttttttactcttgaattttgagagttctccatattctagacctttgttggatatgtggtttgtgaatattttctcctagtctgtagcttatgttttcatcctcttaacctagggtcttttgcagaagaaaggtttttttaatttttatgaaatccagtctatttttttctttagttgcttgtgctattggtgtcatatctaagaaagcattgccgggctcggcatggtggctctcacctgtaatcccagcactttaggaggctgagacaggcagatcacttgaggtcaggggttcgagaccagcctggcaaacatggtgaaaccctgtctctactaaaaatacaaaaaattagctgggtatggtggtgcggacctataatcccagctacttgggaggctgaggcaggagaatcgcttgaactggggaggcagaggttgtagtgagctgagatcacgccactgccctccagtctgggcaacattgcccagtccatgccctcagagatttatacgtatgtttttttctgagagttctgtggttttagttcttccatttaggtctttgatccattgagggttaactttttatatagtgtgaggtgtgggttcagattcattgttttgcatgtgaatatctggttgtctcagcaccattttttaagaagactgttctttgcccatcagatggtcttggaacctttgtagagattaatttgaccatctgtatttatgagtgtatttctagactattaattttattccattggtctatatgtctgtcctgatgctcataccagactgacttgattactgtagttttctaataaggcttgaaattgtgaagtatcagccttcacttttgttcttctttttgaaagttattttagctattctgagtcccttgcatttccatgtatattttaggatcagcttgtccatttcttcaaaaaagattgacggggattacacggaatctgtggatcaattaaaaagtattactatcttaatagtattaagactaatctcagcactttgggaggccaaggtgggcagattgcttgagtccagaagttggagaccagcctgggcaacatggcaaaaccctgtctccacaaaaaatacagaaattagccaggcgtggtggcgtgtgcctgtagtcccagctgttcagaaggctaaggtgggaggatcacttgagcatgggaaatggaggtcatagtgagccaaaatggtgccactgcactccagtctgagtgactgagtaagactgtgtctcaaaaaataaaaagtattaagtcttacaatccataaacttcatgtgtctttctattcatttaggtctttaatttttttcataatgttttatagttttcagtgtacaagccttggacatttttggttaaatttattcctaaatagtttattctttttgatgcttttgtaaatggcattcctttcttaatttcattgtctagagtggctagtaaagctagcatatagaaataaaattaactttgtatatggatcttaaatccttgactttgctgaatttattagctgtttttatccattagtgttttgaagagattatgtagaattggtgttaatttttttttaaacatttgatagaattggtggaacagtctgcttagagattttactttcaggagttttatttgtttattttattttattttatttttatttattttttttctattgcctaaacataggcaggcacattttcaggagtttttacatttcaaatttaatttccttcatagatatagggctattcaaatgatctatttcatattgtgtttgtttttgtaaattgttttcccagaattgatccatttcataagcttatcaaatttgtatgtagaattgtttctagtatttattacccttttgatgtctgtagagtgtttagtgagtgagatccatcccgtttcattgctgatattagtaatttgtgtttgtcccccttgcttgaggattattaattttattgatatcttcaaagaattggctttgtttcatggatttttctctattttctgtttttagttgtattgatttctgctcttatttcctttattctgcttgccttgtgatataaatttccctttcagcagtgatttcactatatcctatgaattttgatacatggtatttttattttcattctgttccttgtatttttaaaaatttatcttgagacttcctctttggccattggttatttagaagggtctaagtaattttcctgttatgtttctgttgattctagtttgatgccattgtggtgacagaacacacttacttgatttaaattctattacatttatttatttatttgagactgagtcttgctctgtcgcccaggctggagtgcataggtacgatcccggctcagtgcaacctctgcctcctgggttcaagcaattctcatgcctcagcgtcccgagtagctgggattacaggcgagtgccaccatgcctggctaatttttgtatttttattagacacagggtttcatcatgttggccaggctggtctcgagctcctgatctcaagtgatccactcgccccggcgtaagccactatacccggcctaaattatattaaatttaaatgtgatttaggtatagactatttacatttagtgcaatcatcgacatgttagggtttaattctgcttttttgatgttttgcctttttttttttgtcttcttgtgggttacttgaactgtgttttagaatcctgttttactttatgtttttaaatgtgtttctttgtatagttttttcagtgattgctgtaggtgatttcattatctgtataaaaaagatgtgattaacctagttgccattttttgttgtggaatcctttgacttcttgccatcacagctacctgtaagctgctggcattgtcttcattaccattatagttttaaagaactttgtgctgtattcctagataagttatttttctcatgttgcatgctaaaatgagttgaagcagtgagttcctcctaagagtccttgtctaatttaaatcatacctctttaatgtaggtaagtctttgctgaaaaatatttcagttcatttgtgctggcgtggtaagtggacatggctcaggaggtttaatacaaattgcaggaattcttgttttagaggtagttgttttttccccccacctctgtggtttgacagtattttggtaacactggggaattgggtttttccttttctgccctagagcactgtttaactgtactgctgtattcactggtacgctttcactttaatggtttaaaattggtcatcacattcagggtgtctgttactgtactgtaacaagattttatattgttgaagtgtaggactgctgggtttacagttttaactgtggttatatcattttagtaatttggaaggtagactgtattttgtctctgtgcactgtagacagtaaatatttatgaaattgaacacttacagagaattcaaattttatttccaaaatcatgatttaaaattaaacatttttttctcctcagagtgacaaaaagagtagtccccagaaagaagttaagtatgaacccttttcttttgctgatggtaagtaacattctcattttaattgagttattgtatgtgggtctttttaaggtaaaatttacatcttaccccatatttacttattctgatgtgcttttcaaacaaaatgtcaggtttcttgaacaatttaccttaatgacatatagtaaatttactcattggcatacagttctatgagtaagttacttattaaaacatcaatcatgaagccttaactatgattggacagtagtatcttattggattctgataatactttcgtaatgtgaactttagagttattcttgttacttagcttgagaaggcacatgtctattcattgtctaatattaatggatttacatctttctttagatattggctccaataattgtggatactatgacttacaagcagtactaacacaccagggaaggtctagttcttcaggtcattatgtatcatgggtgaaaaggaaacaaggtaaagggtattcttttttcaactgttcaatattattttaacagttcatttattataaattttatagcagtgtggttttcaaactttgggtctcagaaccactttacattcttgaagccccaaagagctttggtttatgaggtttgcctctcttaatacttactgtattagaaattaaaactgagaaattaagaaagttagttttaaaaatgatagtaataagcccattacatattaatgtaaaaacaaaatgagtgagaaatggtactgatttacatttttatgtctttctgttgtctggcttaaataggaggcagctgggttctcctgttagtgttcgcattcagtctgttgcattatcatacattatgtagcctctggaaaattccagagtacacttgagagaatgtgggtggaaaaggcaagcagtgctctagtggtgtcattgaagtagttgtaacctggtggaacccctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttat

SEQ ID NO: 988 - DNA, 55258 bp, Homo sapiens; identical to SEQ ID NO: 987

SEQ ID NO: 989 - DNA, 58473 bp, Homo sapiens
caaaattccttatccaataatacataattaatttttattaacagtccaggatttgtttagcatcttgtttaacatttgaaaatcaaaacataaactttttggttctcaaggatagtgctattaaaagaaaatcttgaacatcagtggttagtaattttttacttacagaacaaaaacttctgaaatttcattgtgggacttaatctatttacattcctaaaactgagaataattaatgtatttgagatccttgtatgctagtatacattcataaggttctactgttctcatgaagccatttgactggcaaacatattcattacagtttcaaaagaaaacaccctatttgactcaccagaaaaacctttgtgatctatatcctactatttctgctgctgctgctgagcatggaatacatgtggggttgaaacaggggaggaaagagatagatttattagggtaataccaacttttatggctccccctgccccctccacctaaaattaggaggtcagtgaaagaactgcaaatgaatgtaaagaggaatatttcctgtactactgtagaaattttagagattaaaaacccctatgatttgttctgtaccttttgaacaatgaatgacacccctcccatctattttccaattttatagtaaaaatcggatttagaatcagaatctaaaattttcctttggtgtaaaaaatagttttgcattttatgaaaacaattgtccttttaaaaattaatcacatatataattgaatatattggttgcatatcagaagaaaaggtttaaggattaaagcattcaaagaacagtaatttggtggaatttcagtcagtgttatgggatcatgtcagagatgaacccttttatcaaaattccaaaggtggatccatattttataaaatttgataccaaataaattatgttataggaagatttcaatattgtctcaaacactggagaaaaaatttaatatagtcaaattacatgaaaaggcaagaatactgatcatgttgatggtatttctaatatttggaaaatgttataaaaaagaagtataaatactattcagattctgaaaaccatggcagacgcaaaattaaataaggagtaacagtaataaatgaattaaaaattagacaaaagcatattaaatgacaaaacagcaaagcaaaaatagaattgtcattaatattaaatagtatactgttgtaaaatatatgaaagtattaaaagtattataattaaaaatgattcttatcctaaatatgaaaataaatatcaaataatatgaaacataacatctaattgtttgataagaaaaaataacacaaagcagagaaaataaaagacacctcactattcccaatgtggttattatttatggaatggataaaacatgttgtagaaaaggtcattacagttaggttagcacataaaaaaccaacatgccacatctacctaaataattttgtagaacagctgaaaaagcaaatttcatcaaatttagacagcttatagtggaataactgagtatggtgaggtattaactaacactaagtttcacaacgggcagcttctagctggttcgttgaagctggatctcggccacgcaaggatcattggacaagaaatcagttgagctggaatagagctgcccaattgtcttaataatgaatgctccacactgtctgttaagtaaagagaaaatatagatcaggaagactgaatggaaaaaaaaagataagttagaacagatgagtacagaccatcaatcaacattcactaaatatttgcagaaccttggtaccaattaaattagaatgttacaaagtgagaggctagcaatttaggagggctccagaactcaggaaaacctgctctctgagagcttagaatctatattagacaatctctagtctagtgttacagtataaatgttgagtaaataaaatgagggatgggtcagcacagattacgagttacaacatttccttctattaggtgggtcttaaaaacttgtttttaaaaggggaatagtatttttggcaggaggctatttagaacgctgtccaggggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgtgcaccgtgcgcaagctgaagcagggcgaggcattgcctcacttgggaagcgcaaggggtcagggagttccctttctgagtcaaagaaaggggtgatggacggcacctggaaaatcgggtcactactgcgcttttccgacgggcttaaaaaacggcgcaccacgagattatatctcgcacctggctcggagggtcctacgcccacggagtctcgctgattgctagcacagcagtctgagctctaactgcaaggcggcagcgaggctgggggaggggcgcccgccattgcccaggcttgattaggtaaacaaagcagctgggaagctccaactgggtggagcccagcacagctcaaggaggcctgcctgcctctgtaggctccacctctgggggcagggcacagacaaacaaaaagatcagtaacctctgcagacttaaatgtccctgtctgacagctttgaagagagcagtggttttcccagcatgcagctggagatctgagaacgggcagactgcctcctcaagtgggtccctgacccctgacccccaagcagcctaactgggaggcaccccccaccaggggcacactgacacctcacagggcagggtattccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgtctctcctcctccaaaggaacgcagttcctcaccagcaacagaacaaagctggatggggaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgaagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttgagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcttttacagacaagcaaatgctgagagattttgtcaccaccaggcctgccttacaagagctcctaaaggaagcactaaacatggaaaggaacaaccggtaccagccgctgcaaaatcatgccaaaatgtaaagaccatcgagactaggaagaaactgcatcaactaatgagaaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccacctcacttgcagagacacacataggctcaaaataaaaggatggaggaagacctaccaagccaatggaaaacaaaaaaaggcaggggttgcaatcctggtcttggataaaacagactttaaaccaacaaagatcaaaagagacaaagaaggccattacataatggtaaagggatcagttcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaacagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaactgctcaaatacatggaaactgaacaacctgctcctgaatgactactgggtacataacaaaatgaaggcagaaataaagatgttctttgaaaccaacgagagcaaagacacaacataccagaatctctgggacgcattcaaagcagtgtgtagagagaaatttatagcactaaatgcccacaagagaaagcaggaaagatacaaaattgacaccctaacctcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgagcccacagaaatacaaactaccatcagagaatactacaaacacctctacgcaaataaactagaaaatctagaagaaatggataaatttctcgacacatacactctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaacaactggtaccattccttctgaaactattccaatcaatagaaaaagagggaatcctccctaactcattttatgaggccagcatcattctgataccaaagccaggaagagacacaacaaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaagactggttcaatatacgcaaatcaataaatgtaatccagcatataaacagagccaaagacaaaaaccacatgattatctgaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacggggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaggctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaagaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatagagaccaatggaacagaacagagccctcagaaataatgccacatatctacaactatctgatctttgacaagcctgagaaaaacaagcaatggggaaaggattccctatttaataaatggtgctgggaaaactggctagccatatgtagaaagctgaaactggatcccttccttacaccttacacaagaattaattcaagatggattaaagacttacatgttagacgtaaaaccataaaaaccctagaagaaaacctaggcaataccattcaagacataggcatgggcaaggacttcatgtctaaaacaccaaaagccatggcaacaaaagccaaaattgacaaatgggatctaattaaactcaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaaccagttcaaccattgtggaagtcagtgtggcgattcctcagggatctagaactagaaataccatttgacccagccatcccattactgggtatatacccaaagggttataaatcatgctgatataaagacgcacacgtatgtttatcacggcactattcacaatagcaaagacttggaaccaacccaaatgtccaacaatgatagagtggattaagaaaatgtggcagatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaaaacttggacacaggaaggggaatatcacacagaggggactgttgcgggtggagcggggagggatagcattaggagatatgcctaatgctaaatgacgagttaatgggtgcagcacaccaacatggcacacgtatacatatgtaatgaatctgcacgttgtgcacatgtatcctaaaacttaaagtataataataataaaattaaaaaaaagaattctatttaaagtctgcataatgaaaaatgaagcagaaaattactgcaaaaatacactgtacattcttacaaagtgaaccattgagataactatttccaggttacatgatacatttgaggtaaaagttactgtaaaatttatttaaaaaaatggataagatcaaggggaaatgtgatctattttctctctttagaagcttttggaattttttctattattcctgccattctgaaatttcacaataattggccttagtgtgagtcttttgcagtaattgtggcaagtagttggtaggccttttcaatttagagactcttgtccttaagtttctaggaagttttcttctattaatttattgataatttcctccaatgatttttctctattcctctttctgcaatttaaaaaatatttgacttctgggattaatctaattttatcttttctctattattattcacctcagtcttttttgattctacgttctgaaaacttttgcctgtaatatttaactcacacataatttatttcaattatcacattagtggaaaaactagtgacattttagaataaggtgtatagtttagacgactgtactgatgttcatttcctgtgcctgtgccctctagccaaaggatgaagtaggtgaaggatatacagaaactctattatttctataacttctcagtaaatctgaaattatttcaaaatgcaaggctaaaaaaattaaaaggacagatatttgagagaaaaagtatcaggctgtctatgcatgtcccacttctcattagtttttgcctgtttcggagaggatattaattgtagtttctttgatattttcttctgctccctgcattgtatgtttcttatgaatttctttttttctgtttattttgttctctcaccctagaggttttcttctaacgtggctgcacgtcatagttaagagggaggcactaaaatcctaatgggaagttctttgtgcatggtttgtcagtgatcttcacttcaaggatttaagagaccatcgaactttttctctgtggtagaaagcatgcttggattagaatcctggatctgccacttactcaactatgctactgtgggcaagttactttttaagcttaaagtgatcaaattaacactgccagtaattagacatattggcatctcatatcccctgatatgacacactgataagggcatatcacctctgtgatattattgtcccaaattcataccctttatctaattaagagaaaacataggccaacaaaagtgaagagtgttctacaaaataactaatcaatattttaaaaaagaatcaaggtcatgaaagacaataaaagactatgtaaatgtcacagattggtggagaataaggagacatgacaaattaatgtaggatcttagattagatcctagaacagaaaaagaacataagtgaaaaaaatggtgaagtttgtagttcacttaataggtctgtagtttacttaacagtactttatgaatgctaatttcttcgttttgctaattgtttcaattataagctgttagaagttgagtgaagagatacatgaactctatgtattatttttacaacctttctgtaagtgtaaaattattttaaaataaaatgttaaaaaataggttaaaaggccaaggacatttggtgggatgggatgatgggggaggataactgccaggatatctatgcatgggttgcttctcattaattttgcttgaggcatgatgaatccttttttgatttgtaaattcaagtcacagtgtttttgattttgttttgctgttaaaatttctgcacattctttctgttccatttattctgtattcttttcttgagaattactatttttttggttggacctgtctctctgctctctctattctagcattttatctcatcatttaatctttcatgttattttcttttacattctggaagaattaaaaatatccctctctatgaaggatttcattttcttttgtgactactggccctttatgacaaaggcaaatatgattctttccatcatgtcaatagtttttgggcagtattttcttacactagccagcaaccatttcatttttcctgtttttcagcttgcaattgtttcttaaagatctattactgagaacatgggatacatcttaaaaattgtatttaatttcctctaatacatacgttcttatacatatatacatatttatactattcatccttgccttcaatgtagtgccatattcaattttttttcacagaatccatataatacatacttttctgtttactcatccttgaatggggatctactcatgacaattagaattggtgtcatgaacacttgattctccttactgtccttacatcaaaaaggagtcttggtagacacagaacctatacaatttctaatgtctaagtgggtgagcattttttgctcctcctgcctagttctttatgagtaaaaaacttattctagagaatctgaggctgtctattgtttgactatatatagcatacatgaaaatttataccctccttatatattcagagcttttcctgcctctgtcctctagattacattgctttatacttgtccttcccaggtttttcagaatacaagacaatttgagtctctaaattgattcataagtattaatgatactcaaatgaggaaatggttgggaaaaaaatactggtagtggaatctttttgtaaagcagatatagttgctaatttttaggtaagtgcacgctctgggcctctgaactagaagtagatagtggtagtagttcagatccctctccaatttacttctgaatcatactttgtcgaccattagttgtgtttttcatttaagtccaatcagtattttacttagaagaaattccttatagcctgggcaagaggttaaatatgatccttaatagccatatgttttcatcgattgttagtagacatgggagttaaataaaatacacattgaacttaatccatataagaacaattttattagatgcttatattaatgcaaaaatgtaaaaacactgtaagaaaaccaaaacacttgagaattctccacttatacccttcataccttgggatttgatatttatcttagaaacataatagttcacatacccagaaacacagattttccttttgttccttcctagtctagttcagtgggataattttgacattatgtggttttgctttttttgactttaaaacttaattctcttttatttcttttttaaaattagagatggggtctcgccatattgccaggctggccttaaactcctggctcaagtgatcctcctgccttggcctcccaaagtgctggggttcaggtgtgagttaccacacctggcctaaaacttgattctgtataagatgttactgctgaattagggaatgatggccctaattagtattatattaatctagttacctctatattggtctgttttgtatttattcgtttttgtatttgatttgacagagtatgtaggctgtggcttacagccaatgagtagtttctggtaaacagtacttcacagcagttagacttgtgcttcaaactctgcataaggtttctattttatggaatagatttgttgcttcaagataattttgacatttgaaattcctactttgggatatcttcaattaacattcatgagttgtaatcattagagctttaaaaatgagttttacgcttataaaaacaacaactcctccaaagaatatttccacctttctattttaaaagtcaccaagatttttggtactagagaaaatttgcattggaagtaaaaaaaggctaatgtttcaaatgtcattcactaatattttaatattagtaatatgttctagaaaaagattgtttcataatgtagaacaacatttgtatattaagatttccatgttataatagaaatgcactgtaaatgaaaatagataatttgccacatagtaatacatgcatattaaagcatttctacagcattatatagttctagaaaactacagaagtggttttggagtttctgtctctgagtggggtatcgttttgtattgagggccactaagtcacctaaagaaaaatattgagtataaaatgcatagaacatttaatcttaaaaaataaaaatgagaaacacaaaattctacataactatcttgtgctccagttttgactttggaagtctatttttttccatctctaacaaaagaggaattggtaattattattatttttttattttagagatatacatggtttcactctgttgcccaaactagaatgcagtggcgtgatcatagctcactgtaaccttgaacctttgggctcaagtgatcatcctgcctcagcctcctgagtagttagcactataggggtgcaccaccatgcccagatagtttttaaaatttttattttgtagaggctgaggagttagcactataggggtgcaccaccatgcccagatagtttttaaaatttttattttgtagaggcagggtctcactatgctctcaaactcctggcttcaagcaatcctcctaccttggcctcccaaagtgctgggattgcaggcatgagccaccacagttggccagaattggtaatctttatatgactatattaaagagtaagataccagtttctctgtacaatttctgatgttacctactcacagatctaagaacatttagagaaatatatactcttaaactagaagaattaaattttaagaatgtttaacattaacatcctttggaaatttctcctatccaaataccacccaccactccatcctctattcaaattattcaatttgtataattgtataaattacacaatttccatcactttgtgatatagctctctctcagtaactgaaaataactatcacttacataatatggcatagcaacatcagccatttctgcaaaagtatatttggagtaaatgttaacgacagaagaagtctattttagaagattttctaacaatactaaaaatgaagcctctatgagtaatgtttagtaacactataggttttgacaatatgtcaaaattatggttttatttcatgtttggtgtatagtgataaagccaatgaagggatgcagtgagtggtaatggcagtgagtggtaatggtgtgaagggtcacgagaagaccgggaggctccttaaagtagactgtcttggtattgagttcaacacataggatgggccagaacataaatatgagtgtgaaatagctaatatccattattttaatgcaaagactatgcctaccttcctcaccaaagtacactgtatgcaggattcatattaccatctcaacagttgatcagtctgtggctctttactgcagataaagttcatttccttaaagggatgatgcaagagtttcaccaagaaacttgttcataagggaataggaagaattccctgtacatagtagatagtcaaaatatattgagtgtatacatgggtataactggattatcattctttggcctgaatctgactaaggaggcatgaacatggttcccaaactggaaaaggagatcattaattgttttcacctccccataaatgtcacatgtcatcaacatagataataaaaatcagagtactgtatattaaatatctagaataggcaaattcatatagatagaaagtaaattagaggttaccagggactaggggttgagaggaagcacataggaagagttattgcttaatgggtgcacagagtttcaacttgggatgaggaaaaggtttgaaaacaatggtgatggttgcatagcattgtgaatgtaattaatgccactgaattgtacacttaacaatggttgaaacagaaaatttttaagtttgaagtcaggtagcgtgatacctccggctttgttcttttggcttaggattgacttggcaatgagggctcttttttggttccatatgaactttaaagtagttttttccaattctgtgaagaaagccattggtagcttgatggggatggcattgaatctataaattaccttgggcagtatggccattttcacgatattgattcttcctacccgtgagcatggaatgttcttccatttgtttgtatcctcttttatttcattgagcagtggtttgtagttcttcttgaagacgtccttcacatccctcgtaagttggattcctaggtattttattctctttgaagcaattgtgaatgggagttcactcatgatttggctctctgtttgtctgttattggtgtataagaatacttgtgatgtttgtacattgattttgtatcctgagacttttctgaagttgcttatcagcttaaggagattttgggctgagacaatggggttttctagatatacaatactacaaggctacagtaaccaaaacagcatggtactggtaccaaaacagagatagagaccaatggaacagaacagagccctcagaaataatgccgcatatctacaactatctgatctttgacaagcctgacaaaaacaagaaatggggaaaggatcccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagccatggcaacaaaagccaaaattgacaaatgggatctaattaaactaaagagcttctgcacagcaaaagaaactaccatcagagtgaaaaggcaacctacaaaatgggagaaaattttcacaatctactcctctgacaaaggatatctctaatatccagaatctacaatgaactcaaacaaatttacaagaaaaaaacaaccccatcaaaaagtgggtgaaggatattaacagacacttctcaaaagaagacatttatgcagccaaaaaacacatgaaaaaatgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacaatgttggtgggagtgtaaactagttcaaccattgtggaagtcagtgtggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaacgatagactggattaagaaaatgtggcagatatacacctcggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacactccggggactgttgtggggtggggggagtggggagggatagcattaggagatatgcctaatgctaaatgacgagttaatgggttcagtacaccaacatggcacatgtatacatatgtaacaaacctgcacattgtgcacatgtaccctaaaacttaaagtataataaaataaaataaaataaaaattttttaaaaaagaaaatttttaagttgcatatattaccacaataaataaaaaagttaatagttaatttagaattatatttccttcacatgagtttgctaattctgtacttctgatcacaagtgtgatgtaaatatccaaaattgttcctttctagaagagaaagttggaaaacttgaaatatgatggaagaaaaacaaagtaaaaagtcaaaacaaatttcttactttaattggctcaggctgcatcacaggcgcaggcatagtgatggcacttggagcataaacctggtgatatgttgcttgaactccatgatcagaataaggctattacaaaaaaagagagaaaaaatgtcacctttcatctattaattctaaatatttactcagcatttacaatatactaatcatctagctatacaatgtagaaacagttaaaaacacatgcccttatgtttaattaacttataatctgatgagttaatataatgaattaacttatgaattaacttgtaatctgatgagggaaatagacagtagtcagaatgatcataaatcctatagacatgtatagggatgcaacaggcaagggaagagattatgtaaatgcagttatggcttgtccagcagatggtggtaccattcattggaatatagaatacaaggaaagcttaatattcatgtaattgtgtgtaaggggttgcagagcaggagttaggtttgtgatatacaaaatttgtggtatctgtaggaattctagtagacgtatactgttgatagatgtggctctagaccaggactgtcaaatagaaatacaatgtgagctacatatgttatttaaaattttcccattgtcatgttagaaaaataaaaaatggtagaattaatttttagtaataccttttatttaaactaatacatattaaatattatcatataaaagtacaatcaatacaaacattaccaagatgttttacattcttttttcttttttttttgagatggagtcttgctgtcttccaggctggagtgcagtggtgtgatctcggctcactgcaagttccacctcccggcttcacaccattctcctgcctcagcctcccaagtagctgagactacaggtgccgccactacacccggctaattttttgtatttttagtagagacggggtttcaccgtgttagccaggatggtcttgatctcctgacctcgggatccacccgcctcggcctcccaaaatgctgggattacaggcgtgagccattgcgcccagctacattcttttttcacactgtgtcttcaaaacccagtatgtattttacacttaggggacatctcaattcggtcttactgcatttcaagtgctcaactgccacatgtggctagtggctattgtagtggatagtgcagtctaaaactcaggagtgagacggaggctagatatatggctatggatgataacatcagagtgagtacatgtggtgaaagaatggagaatcaaatacaaaatctgcttataaaggaaaacaaaaggaggtaaaaggattgccagaagagagtagtatcatggaaaccaagggtaggaagagttttagggagtaggtacaatgtctctgagaggtcaaataagataaaaaagaaaggaaagtttgtgtcagttaggaagtcattgaggacctttacccaaggcagcttcagcagaaaggtaatgaagtagacttcagcaggtgaggagtgaatgagtagtgaagtagcagaaattctgaatgtagactactttttcaagacacttggctttggaaggtagcagaaaatcagggaagtggtgggagtgtgtgtcacaggataatattgcctcttacaaggtgctgcacactatacaaagaactttgtataccatctctctagtctttacatcaatcctgcaaaatagtttttcctgatgtcctcattttacaaataaggagattatgaaagcaagaccatgaagggttaagcaattcctcaaagtaacacagtaagttgtgaagctgtaaaccagtggagagaagaagacttcaaatacaagacagaaaaagaacagtagatggaatgaggtccctgaggaggagggaactgatagcatctagatcgcaagaggcagaaataaccttggacaagactgaaagtcactaaataaatataagaagctaaggatgagttacgatacaggtaaagtttgtgtttcaggggttggaggctgagttggttttcacaaattggttcttactctgcaaaagagaaggcaaagctatattctcagaatgacatgggcaggcagtggagtgggtgcaatctggtagtactgagggcttggcaaaggtttaaaataatcattgaaataagtgagtgaagacggtcacttttttttttaaaaaaagaaatttgactataacactcacaagaaaagtcgtgaagttcttaattttagggaaaaaaacacttcaactgtaaaccatcccactctattcattaagttatatattagtcagactataccctctactagaaacagtagcaaaacaaaaacatgcaaatattttgtatggaaataccacacaaagtacaagttataagataatgatgggcaatattttcagaaaagctttattagattccattaaatagtgcatatattctgatggtaagtatctgatatcagatattaaaaatatgatttaatgccaaaagagattctgacaaaaaatcaaatgtaaaagcattcttatctcactacctgctcctggcaaaccagaaaacaacaaaaagaacaaaatatagatttttaaaatgccatcatcaattaaagaagaaaatgcctatgactcccaaaccatacacaatgtagaatgtctgccaagtgctgtgcaagttggacgaacataagggaggattctgaagcctcctcagtcatgagaaaggatgacgatttcccaagaggtcaatgttctggaagacctcctcaaagatactttagagtcttgagtgcagaagtatgtattggtcagagtgaggtagaagcacaaaatatctccacagagatcctattcataattaggataataattaataataattaagaatcctgacttaacaggggaggtagaattgatggagaaatcatgtttatataatttttcttgtctactatctagccttttacctgaggaatactgctggaggtgaagcagggagaaagtgggaaaggaagtagcaattgccacatcccaatacagaacccctgtgataaaaagggctttacaaggaacaaaaatgatctctggcaaggatgtggaggaaagggaatccttgtacactgctggtgggaatgtaaattagtatggccattttggaaaacagtagggtggtttctcagaaaattaagaatactatcatgtgatctagaaatcccactactgtgtatacatatccaaaggaaatgaagtcagtatgttaaaaagatatctccatttccatgttcactccagcattattgataatagtcaagatatggaatcaaccttagtgtccatcaatcagtgaatggataaagaaaatgtagtatccatatacacaatggaatactgttcagccttaacaaagaaggagatcctgtcatttatgacaacatggatgaacctggaggacattatgctaagtgaaataagccaagcacagaaagacaaatactacatgatttcacttatgtgcagaacgtgaaaaagtcgaactcatagaagcagagagggccaggtgcggtggcttatgcctgtaatcccagcacttttggaggccgaggcaggcggatcatgaggtcaagaaatcgagaccatcctggccaacatggtgaaaccccgtctctactaaaaatataaaaattagcccggcatggtggtgtgcgcctgtagtcccagctatttgggaggctgggacagggggatcgcttgaacccgggaggcagaggttgcagtgagccgagatcatgccactgcactccaacttggtgacagagtgagactctgtctcgaaaaaaaaaaaaaaaaaaagcagagagaagaatggtggttgccagggactggggatggcgagtgagatgggagatgttggtcaaaggttacagggtttcagttctaaaggaagaatatgccctgaagatctactgtatagcatgactatagttaataataacatattatatacttgaaaattgctaagacttaaagtaccttaaatgttctcaccacaaacaaaaaaaaggataaccatgtgaggtgatggattagcttgattggggtaatcatttcacagtgtgtacatatatccaaccatcatgctatacactgtaaatgtataccatttgtcgttagttacaatttagtaaagctgaggataaaaagaaaaaagcaaccataaaaaagtaggtggggcaggccaggcgcagtggctcacgcctgtaatctcagcactttgggaggccgaggcaggctgattacgaggtcaggagattgagaccatcctggctaacacggtgaaaccccgtctctactaaaaatacaaaaaattagccagacttggtggcacacgcctgtagtcccagctacttgggaggctgaggcaggagaatcacttgaacccaggaggcagaggttgcagtgagccgagatggcaccactgcactccagcctgggcgacagagcgagactcgggctcaaaaaaaaaaaaaaaaaaaaaaaaggtggggcatgaaacaaataataaagaaatcctagtaaaagtattgatagtaaatcttaagatccaactgtggaaattattgtttcagaacaaaattataatattaaaaaagtaataaaacaatgtacttaaactgggaggtaaatgctaatttcttaatctttcaccacactgatttaaaacataccatgcacatggtactggtacaaaaacacagaccaatggaacaggatagagaactcaaataagaccacatatttacaaccatctgattttcaacaaacctgacaaaaacaagcaatggggaaaggattccttgtttaataaatggtgctggggaggtccagggcaagatggccaaataggaccagctctggtccgcagcttccagtgagaacaatgtagaaggtgggtgatttctgcatttccaactgaggtacccagctcatctcactgggactggttagacagtgggtgcagcccacggagggtgagcagaagcagggtggggcgtcacctcacccgggaagcacaaggggtcagggaactcccttccccagccaagggaagccatgagggacagtgatatctggctcagatactacgcttttcccatggcttttgcacctgcagaccaggagatcccctcgggtgcctacaccaccagggccctggatttcaagcacaaaactgggtgcccatttgggcagacaccgagctagctacagggttttttttgttcataccccagtggcacctggaactccagagagacagaaccattcactctcctggaaagggagctgaagccaggagccaagtggtcttgctcagtggatcccacttccatggagcccagcaagctaagacccactggcttgaaattcttgctgccagcacagctgtctgaagtcgacctgggatgctcaggcttggtcaggggttggggcatctgccattactgaggcttgagtaagcggttttccactcacagtgtaaataaagccactgggaagttcggactgggcagaacccacctcagtactgcaaagccactgtagccagactgcctttctagattcctcctctctgggcagggcatctctgaaagaaaggcagcagccccagtcaggggcttatagataaaactcccatctccctgggacaaaacacctgggggaaggggcagctgtgggtgcagcttcagcagacttaaatgttcctgcctgccggctctgaagagagcaacagatctcccagcacagtgcttgagctctgctaagggacagaatgcctccttaagtgagtccctgacacctgtgcctcctgactgggagatacctcctagcaggggttgacagacacctcatacaggagagctccagttggcatctggtgggtgtccctctgggacgaagcttccagaagaaggagcaggcagcaatctttgctgttccgcagcttccgctggtgatacccaggcaaacagggtctggggtggatctccagcaaactcctacagacctgcagcagaggggcctgactcttagaaggaaaactaacaaacagaaagcaataacatcaacatcaacaaaaaggacatccacgcaaaaaccccattcacaggtcatcagcatcaaatatcaaaggtagataaatccacaaagatgaggaaaaaccagcacaaaaaggctgaaaattccaaataccagaatgcctcttcccctccaaaggatcacaactcctcgccagcaagggaacaaaactggacggagaatgagtttgatgaattgacagaagtaggcttcagaggtgggtaataaactcttccgagctaaaggcgcatgttctaacccagtgcaaggaagctaagaaccttgataaaaggttacaggaactgccaactagaatagctagtttagagaaaaagaaaagtgacctgatggaactgaaaaacacagcacgagaacttcgtgaagcatacacaagtatcaatagctgaattgatcaagcagaagaaaggatatcagagatggaagattgacttaatgaaataaagcgtgaagacaagattagagaaaaaagaatgaaaaggaatgaacaaagccttcaagaaatatgggactatgtgaaaaggccaaagtttaggtttgattggtgtacctaaaagtgacacggggaatggaaccaaggtggaaaacacactcaggatattatccaggagaacttcctcaacctagcaagacaggccaacattcaaatttagaaaatacagagaccaccagaaagatactccttgagaagagtttggtgggaagcccaccaaactaacagcagatctctctgcagaaaccttacaagccagaagagagtagcggccaatattcaacattcttaaagaaaagaattttcaacccagaatttcatatccagccaaactaagctttataagtgaaggagaaataaaatcctttacagacaagcaaatgctgagagactttgtcaccaccaggcctgccttacaagaattcctgaaggaagtactaaatatggaaaggaaaaaccagtaccagtgactgcaaaaacataccaaaatgtaaagaccatcgacactataaggaaaccgcatcaactaatgggaaaataaccagttaacatcacaacgacaggatcaaattcacacataacaatattaacttaaaaggtaaatgggctaaacgccccaattaaaagacacagactggcaaattggacaaagagtcaagacccattggtgtgctatattcaggagacccatctcatgtgcaaagacacacataggctcaaaataaagggatggaggaatatttaccaagcaaatggaaagcaaaaaaaagcaggggttgtaatcctagtctctgataaaacagactttaaaccaacaaagatcaaaaaagacaaagaagggcattacataatggtaaagggatcaatgcaacaagaagagctaactatcctaaatatatatgcacccaatacaggagcacccagattcacaaagcaggttcttagaaacctacacagagacttagactcccacacaataataatgggagactttaacaccccactgtcaatattagacagatcaacgagacagaaaattaacaaatatagtcaggacttaaactcagctctggagcaagaggacctaatagacatctacagaactctccaccccaaatcaacagaatatacattcttctcagcaccacatagcacttattgtaaaattgaccacataattggaagtaaaacactcctcagaaaatggtaaagaacagaaatcataacaaacagtctctcagaccacagtgcaatcaaattagaatgcaggattaagaaactcactcaaaaccacacaactacatggaaactgaacaatctgctcctgaatgactagtggataaattatgaaattaaggcggaaataaataggttctttgaaaccaatgagaacaaagacacaacataccagaatctctgggacacagttaacacactgtttagagagaaatttatagcactaaatgcccacagaagaaagagggaaagatctaaaatggacaccctaacattacaattaaaagaactagagaagcaagatcaaacaaattcaaaagctagcagaagacaagaaataactatattagagcagaactgagggagatagagacacgaaaaacccttcaaaaaaaatcaatgaatccaagagctggttttttgaaaagattaacaaaatagaccactagccagacggataaagaagaaaagagagaagaatcaaatagacacagtaaaaaatgataaaagggatatcaccactgatcccacagaaatacaaactaccatcagagaatactataaacacctctacacaaataaactagaaaatctagaagaaatggataaatttctggacatatacaccctcccaatactaatccaggaagaagttgaatccctgaataggccaataacaagttctgaaattaaggcagtaattaatagcctactaaacaaaaaaagtccaggagcagacagattcatagccgaattctaccagaggtacaaagaggagctagtaccattccttctgaaactattccaaataatagaaaaagagggactccttcctaacttattttgtgaggccagcatcatcctgataccaaaacctgtcagaaaccaacaaaaaaaaaaaaagaaaatttcaggccaacatccctaatgaacatcgaagcaaaaatcctcaataaaatactggcaaaccaaatccagcagcacatcaaaaatcttattcagcaccgtcaagttggcttcatccctgggatgcaaggctggttcaacatatgcaaatcagtaaatgtaacccatcacataaacagaaccaacgacaaaaaccacatgattatctcaatagacgcagaaaaggccttcaaaaaaattcaacaccctttcatgctaaaaacacttaataaactaggtattgatggaatgtatctcaaaataataagagctatttatgacaaacgaatagccaatatcatactgaatgggcaaaagctggaagcattcccttgaaaaccggcacaagacaaggatgccttctctcatcactcctattcaacacagtattggaagttctggccagggcaatcaggcaagagaaagaaataaagtgtattcaaataggaagacaggaagtcaaactatctctgtttgcagatgacatgattgtatatttagaaaaccccatcatctcagccccaaaactccttaaactgataagaaacttcagtaaagtctcaggatacaaaatcaatgtgcaaaaatcacaagcattcagcattcctatactccaataatagacagagaatcaaatcatgagcaaactcccattcacaattgctacaaagagaataaagtagctaggaatacaacttacaagggatgtgaaggacctcttcaaggagaactacaaaccactgctcaaggaaatatgagaggacacaatcaaatggaaaaacattccatgcttatggataggaagaatcaatattgtgaaaatggccatactgcccaaagtaatttatagattcaatgctattcccatcaagctaccattgactttcttcacagaattagaaaaaactagtttaaatttcatatggaaccaaaaaagaggccatataaccaagacaatcctaagtgaaaagaacaaagctggaggcatcacgctacctgacttcaaactatactacaaggctacactaaccaaaacagcatggtactggtaccaaaacagatatatagaccaatggaacagaacagagacctcagaaataacatcacacatctacaaccatctgatctttgacaaacctgactaaaacaagaaatggggaaaggattccctatttaataaatggtgtcgagaaaactggctggccatatgcagaaaactgaaactggacctcttccttacaccttatacaaaaattaactcacgatggattaatgacttaaatgtaagaactaaaaccataaaaatcctagaagaaaacctaggcaataccattcaggacataggcatgactaaaacactaaaagtaatggcaacaaaagccaaaattgacaaatgggatctaattagactaaagagcttctgaacagcaaaagaaactatcatcagagtgaacaggcaacatacagaatgggagaaaatttttgccatctatccatctgacaataggctaatatctagaatctaaacagaacttaaacaaatttacaagaaaaaaacaatcccatcaaaaaatgggtgaaggatatgaacagacacttctcaaaagaagatatttatgtggccaccaaacatatgaaaaaaagctcatcatcactggtcattagagaaatgcaaatcaaaagcacaatgagataccatctcacgccagttagaatggcgatcactaaaaagtcaggaaacaacagatgctggagaggatgtggagaaataggcatgcttttacactgttggtgggagtgtaaattaattcaaccactgtggaagacagtgtggcgattcctcaaggatctagaaccagaaataccatttgacccagcaatcccattactgggtatatattgagaagtttataaatctttcttctataaagacacatgcacatgtatgtttattgcagcactatttacaatagcaaagacttggaaccaacccaaatgcccatcaatgatagactagataaagaaaatgtggcacatacacaccatggaatactatgcagccataaaaaagaatgagttcatgtcctttgcagggacatggatgaagctggaaaccagcattctcagcaaactaacacaggaacagaaaaccaaacactgcatgttctcactcataagtgggagttgaacaatgagaacacatggacatagggaggggaatatcacacaccagggcctgtcagggggtcgggggcacggggagggatagcattaggagaaatacctaatgtagatgatgggctgatgggtgcagtaaacccccatggcacatgtatacctatgtaacaaacctgcacgttctgcatatgtatcccagaatgtaaagtataataaaaaaaaatggtcctgggaaaactgtttagccatatatagaaaattgaaactggacccgttccttacaccttatacaaaaattaactcaagatggattaaagacttaaatgtaaaacccgaaactatagaaaccacagaagggctgggtgcagtggctcatacctgtaatcccagcactttgggaggccgaggcaggtggatcatgaggtcaggagctcgagaccatcctggccaacacggtgaaaccccgtctctactaaaaatatgaaaatattagccagctgggcatggtggcacgtgcctgtagtcccagctactcaggaggctgaggcaggagaatcactcgaacctgggaggtggaggttgcagtgagccgagaccacaccattgcactctagcctgggcgatggagcaagactccgtctcaaaaaacaaaacaaaaaacaaacaaaaaaaccccaaaacacacacacacacacacacacacacacacacacacaaaccatagaagacaatataggcaatactattcattcaggacacaggcacgggcaaagacttcatgatgaaaacatcaaaagcaattgcaactaagcaaaaattgacaaatgggatttaattaactaaagagcttctgctcagcaaaagaaactatcatcagagtcaacagacaacctatagaatgggagaaaatttttgcaatctatccatctgacaaaagtccaatatccataatgtacaaggaatttaaacaaattcacaagaaaaaaacaaagaacctcgttaaaaagtcggcaaaggacacgaacagacacttctcaaaagaagacatttatccagccaacaaacataaaaaaagctcagcatcactgatcattggagaaatgctaatcaacacaatgagataccatctcacaccagtcagaatggcgattattaaaaagtcaaggaacaacagatgctggtgaggctgtggagaaacaggaacgcttttttacactgttggtggaaatgtaaattagttcaaccattgtggaagacagtgtggtgattcctcaaagacctagaggcagaaataccatttgacccagcaatcccattactgggtatatacccaaagaatataaatcattctattataaagatatatgcatgtgtatgttcattgcagcactattcacaatagcaaagacatggaatcaacacaaatgctcatctgtgatagactcgataaagaaaatgtggtacatatacatcatggaatgctatgcagccataaaaaggaaagagatcatgtcctttgctgggacatggatggagctggaagccattatcctcagcaaactaacacagggacagaaaaccaaacactgcacgttctcacttgtaagtgggagctgaacaatgagaaacacatggacacagggaggggcacaacacacattgggacgtgtcggggctgggaagggagagcatcaggaaagatagctaatgcatgccaggcttaacacctaggtgatgggttgatagatgcagcaaaccaacatggcacaggtttacctatgtaataaacctgcacatcctacacatatgtactggaacttaaaataatataaaataaaaaatataaaataaaacataccatgcacagttcctggcatacagatggtgaagctataagtaacggatcagaaatataatttaaagatgctgaagaggatattaaaatttgtaattataaatttaatttacatttttgtaggaagaatttttttaaagattttttttcttcttcatcttaattatatgcttttgactaatagaatgttagtaacaatacagattgacaggcaaaatgagaatgcagagtatttggaattttactatttcaaaaagatcaaatcaaagattagcttagtggagtgaatggttgatttgggaaatggttcagaactagttagcgaaaaagtctaagatgatgcattcttagatataagaaaggggaagagatttgaataaatcaacaaaacaaagatgaagcagtttcaatgagggtcgtgaacaaatttaaaaaagagaaaaagaaataaatgttaacatgaggtagttatagatcaattactttaagactaatacatacctctggaactgaagtttccatcagagacagtggaggaggaacacatccaccatcctgtgcaatttccactggttgataaataacctcagaaggttgcaggtataagaatggagcagaagaggcagaaggctaaaatacaaaaccatatttctaattcaaatatgattagttatttctgttaaaccaaatgacttagccaacagatgagagaagtacttgttttttattttactaaatttttttttaggaatagcacagaagtatctcagcaacggattagaaactgatctgttataaattccaactgtgtagatgtagttaaagaatcttatcattggtaagcactagaacttcttaatgactgagaacctcatatataaattcagataataattatggttatattaatgtcaccagtaaaggttgtgataatgtgatctatggtatttaaattgacataaatgtctactctcagctctgtgacttctaatgaaagtgggaaaatgtgaaacttttttggtgaagtactatttgttaccaaaagttgggaaatagaatacttatttaggaacagaataaaaactgaagccaaatccaaatgaagttagaaaaatgctaaattttcaaataacactaatagtaaaaaagggtaagttttcatgtttatacagtacacatttataaaatgctttcacttatgcattatcatttgatattcacaaaaatcatgtaaggaaacttacaaaggtatagtatcattatatccattttacaaatgaagaaactgaaaatgaactgccaaaagaataagttaataaacagaagaagaaggtctcaaatctaaaaaactttagtattcatgcagtcatcacaagaatataatgaaagaaggatttaaaattatatattgaaagttaacatttacctgaggaacactccactgccactgtcctggtaaatactgtgtggtggcctaaaattaaataaaagaaaagaaaaacccattctgattataaacaagggttaaaactagatatctacaggcaaaaatatgaagttggaccctcacaccatatacaaaaattaactcaagccatatacaaaaattaactcaaaatggaccagagacttaaatgtaagagctaaaattatacatctcttagaaaaaaacataggtgtaaatgcctgtgaccttgaattaggaaatgtttttaaaattatggttccaaaagcataaacaacaaagcaacaacaaaaaatagttaaattagatttcatcaaaactttaaaaaacttttgtgcaagtgaaaatacaacccacaggatgagagaaaacatggaacttatatcaagaatgtataaagaactcttacaactcaataatcaaaagacaagtaacccaacttaaaaattggtaaatgatatgaatagacttttctccaaagaagatatacatatggccaataaacacaagaaataatgctcgacaccactagccttcagggaaatacaaatcaaaaccataatacaacatcacttcatacctactaggatggctttaatcaaaaaagtagatcataaatgttgacgggcacgtggagaaattagaaccctcataatctgctggtgggaatgtaaaatggcgcagccctttgggaaaataaacacttccttaaaaggttaaacaaagttaccgtatgacccagcaattccactctagttataaaacctaagagaaataaaaatatgtgttcacataaaaatttgtatgtgaatgtccatcgcagtatcatttataacagtcaaaaagtagaaacaactcaagtgtccatcatctgatgaatggataaacagaatgtggtacagtgtatccatacaatgggatattatttgagaacgaagtactgagatatgtcatgtctcatttatcatgacatagataaatcttgaaatcattatgctaaatgaaagaagcctgtcacaaaagaccacatattgtatgattgtttttataggatatatccagaataggcaaatctagaaaaacaggtaagtagattactggttgcctagcactgggataaggggaaaaagaagactcaactcatctactgtagcacaaaaacagccatagacaataagtaaacaaatgtggctgtgttccaataatgttttatttacaaaaacaggctgctggctggagtttggtctgcaagccatagtttgatgaccctgctatagaccagaatgatctggcattatagttcacttatccccaatttctcactaaaattaatgaagagtgctggttaactgaaagaggatatcataatatataataaaccacaatatattatttgctttaatataaattatgttaaatataatatagcaagaaactgacatatgttaacattaaaaaaccagcttgcagtccaatacctgtatcttacttggggaattattgctaaagactttttagatctaaatgttagccaggggagcaaaactgacctcatcacatttggtaaaaggaagcaaagagtccatccatcttcttgtatgacattgtttaattccctcgtaaaaaaagagaggcatgatgtcagcaagatggctgaccagagatgcctagcattcattttccactggctccccaccccgccacaagaaaagactaaggcaaagaataaacagctacaatttgacaggagcatcaaaaggagagtgctggagtgccgcaggggagtggagacacacctgtggtgattgcaaatccaggagcgcagcatggagccacccagcctctgcaaacccttctcttctgctaggattggttctgcctggagtcctgcagtttcttattgcagggaaaaggtaagcagaagatccccaccagcctgcattgctactgcaaacagccacactccttgcaacaggagaatcccacagtctcacagtttgaagagctgctgggaattcgtggctgcattgccccgaattaggagtacaaagtgtgtactccccaccccctcaaccccaccctgtgagcgaagctgctacagcgtgacagcatcttgaagccatagtcatctctagggggccagtagctattgcacgtctccagtactggggttccattttcattctgccaagtacacaccagtggctgaacacaacctcagcagcatggaacctgaggctcaagattggctgtgattctggttctgtacagtagggaaaccaacgtctgttgccctcacctccagctagaggaacaatctggctgacctgcccagggtgaacccactctttagctggtcaaactgctgcactctcctgagcaggacaggtcctcaagcctcgtagtagctgacatgctgccgggatggaatggttacacacctgcatacagggctgagaaacagcccagaggtgcctcacgccctgcagacaagcccctgacctaccctgtgcatgcaattagagcccaagaaacagctccggggactgccactggcagaaatgtccccaggggagtggagtggctgtgtgtccatgcctcaggcctaagaaatggcctcgtgcccacccctccagcagacacgtccccaggacagctgagcagcctggagcctgtgtcccaggcctgaaaagcagccccataggctgcttccagtgggcatgatcccaggccgaccaatagccctgtgcctgcattctgggcctatgaaacagccctcacagaaacgtttccaggccgggtgatccaccctgtgcctatgtcccagacttgagaaatagctccgtgggccacccccagcagacatgcccctaggccaggtgagcagttgtgcacctgcatcctgagccggagaaacagcccctgacaaacatgtccctagccgactgaacagccatgcagctgtattccaggcctgagaaacagtcccatgggctgtccccagcagatgcacccccaggccagcgaaggagccatgtgcctgcataccagacctgagaaacagccccacaggctgcctctggtgggcactcctccaggctggctgagaaactgcatgcctgtgctctcagccagagtaacagccctgtggccccaagcccagtgagccagacttaccatgttcatgtacacagccctgacctgaggaacagctcagcaagcccacccctggcaaagccctaccaccattgtcatagactctcttttgctaggtcactgagaaacttggaaacacaactagagagtattacagcttaagagactaaacagagactaccctagcagataggttgaatctagcagattcaatctaaacagatcctctcagaggcacattatagtcaaattgttaaaagtcaaagagaaagaaagaattttaaaagcagcaagaaaaaagtatcaagtcacaattaaaggaatccccattatactaacagcagatttcttagcagaaatcttaccagggagaatgggatgatatatttagatatattcaaaatattgaaggaaaaaaacctgccagccaagaatattatacccagtaaagctatccttcagaaatgaaggagaaatacgatctttcacaaggccaggtgtggtggctcatacttgtaatcccagtgctttgggagactaaggcaggaagattgcctgagcccaggaatttgagaccagcctgggcaacatagcaagaccctatctcttaaaaaaaattagcaggcagggcacatgcctgtagtctcagctgtgtggcaggctaaggtgggagggattacttgagctcacgagtttgacactgcagtgagctatgatcatgtcactatactctgtctctaaaaaaaccagctctttcatagacaagcaaaaactgagagaatttatcaccactagattggccttacaaaaaaaatactcaagggagtctcacatcaggaagtgaaaggatggtaacaacgatcatgaaacatgcaaaactataaaattcactgggacagccattacacaaaggacaaaaagaagaaaagaatcaagccttataattacagagaacccagctgcaaaaaatcaccaaaaagagagggaacaatgaacaaaagatatgcaaaataaccagaaaatgataaataaaatgacaggatgtcctcacctatcaataataaccctgaatgcaaatgggttaaattctccatttaaaagatagagactagctgaatatattaaaaaaagagacccaactatatgctacctaaaagaaactcaccttacctgtaaagacacacataggctgaaagtgaagggatggaaagacatgtttcatgcaaatggaaaccaaagcaggcaagagtagctatacttatatcagacaaaaccaacttcaagttaaaagttttaaaaagagacaaagaaggacatttatataataatatagggatcaattccgcaagagaatataacaatgtaatacatatgtacccaacaaaaagcacccagatatataaagcaagtcttatttgatctaaagagagagggagaaaccccaataaaatagtggttggggacttcaacaccccactctcagcattggacagattatctagaaagaaaataaacaggccgggcacagtggctcacacctgtagtgccagcactttgggaggccgaggtgggcagatcacaaggtcaggagttcgagaccggcctgaccaatatggtgaaaccccgtctctactaaaaatacaaaaattggccaggcgtggtggcatgcaactgtaatcccagctaccgaggaggctgaggcaggagaattgcttgaacctgggaggcggaggttgcagtgagccgagatcatgccattgcactttagcctgggtgacagagcgagattccttctcaaaaagaaaaaaagaaaagaaacaaagaaacatggatttaaactgcaccataggccaaacagacctaacagccatttagagaacatttaactgaacagctgcagaatatactttcttttcatcaggatataaaacattctccagaattaccatatttcaggaaacaaaacaagtctcaaaaaattaaaaaaaactgaaattatataaagtatcttatctgaccacaatggaataaaacaagatatcaataacaagaaaaacattcaaaactatacaaattcatggaaattaagcaacatactgctgaatgaccagtgggtgaaggaagaaattaagaatgaaaatagaaacacagcataccaaaacctatgggacacaacagtagcagtattaagaggcaaatttataacaatgaatgcttacatcaaaaaactagaaatatttcaaataaacacccttacaatgtacctctaggaactagaagagcaagaacaagctaaacccaaaattagtagaagaaaagaaatagtaataatcagggcagaaataaacaatgttgagactacaaaacaatacaaaagattaacaaaacaaaaggttgactttttaaaaagataaaatcgacaaaccattagctagtctaagaaaaaaaagaaagtagacccaaataaataaaatcagcaatgaaaaagacaccacaatgaataccacagaaatacaaaggatcattagaggctaatatgaacaactctatgcaaataaattaggaaacctagaagaaacggataaattcctgaacatatacaatctgccaagactaaaccaagactgaagaaattgaaaaccttaagaaacaaggccgggcacggtggctgacgcctgtaatcccagcactttgggaggccgaggcgggcagatcacgaggtcaggagatcgagaccatcctggctaacagggtgaaaccccgtctctactaaaaatacaaaaaattagccgggtgtagtggcgggcgcctgtagtcccagctactcggaaggctgaggcaggagaatgacatgaacctgggaggcggagcttgcagcgagcagagattgcaccactgcacactccagcctgggcgacagagagtccgtcttaaaaaaaaaaaaaaaaaagaaagaaaaccttaagaaacaaatttaagtaacaagattgaatcagtaattaaaacgtcttccaacaaagaaaagtccagaactacatggctgaattctaccaaacctttagagaagaataccagatcttcccaaactattccaaaaaattgaagcagagggaattctccctaattcatcccattagtttgattatattaaactaaaaagttcctgcacagtgaataaaacaatcaacagagtgaacagacgacctgttgaatgggagaaaacatctgtaaactacttatctgacacagaattaatacccaaaatttacaaggaactgagacatctcaacagcaaaataaacaaaaaataaactgattaaaaatgggcaaatgatctgaatagacatttctcaaaagaagacaaagaaatggctaacaaatacatgaaaaaatgatcaacatcactaattatcaggaaactgtaaatcaaaaccacaatgaggtattatctaccccagttaggatgtttattgtcaaaaagagaaaataacaaaccctggtgaggatgtagagaaaagggaactcttatacactgttactaggaatgcaaactagtacaaccactatggaaaacagtatggagatccctgaagaaactacaaatagaactaccatatgatctggtaatcccactactgggaatttatttggagaaaaggaaatcattgtatcagagagacatctgcacccccatgtttattacagcattattcacaatagccaaaatatgaaatcaacctgggtgtccaacaacagatgaataaagaaaatatggtatatatatacacaatggaatactatttggctataaaaaagaataaaatcctatcactcatggcaacatggatggaactggaggtcattacgttaaatgaaataagccaggaacagaaagttaaacaacacatgttctcactcatatatggaagctaaaaaacactgatctcaaaaatctgccacctgcacagatatttttgaaagaaacaagttttatttttccccctttcttgtaataagtgataaaattccaagtctttttcactgccttccaaaccatgttcagaagagagtagcttatcctctgctggtctacactggttgctgaatttacttgtattcctgtttttgtatatgctgcatttagacttacatatggcaagaaggcatttttgttgttgttgttgttaaaggaaacaaactctcaaatcatgaagtgatgtaaatgttgcatatgcctacaaagctctgaattcaggtcccattgctgtcacaaagaaatgaatgtaactcctaccctaatcccttttttatataataaaactgccttagcatgagttgcaactgtcatcactacagtaagctggtttacagatgttttccactgagcatcacaataaagagtaccatgtgttacaaaaaaaaaaagttgatctcatagaagtaaaaagaatactaggggctgagaaggatagagggaaaggaggaatagggagaggtttgtgaaaggatacaaaattacagctacctcaggaatggaaaaccaaacatcctatgttctcactcataagtgggagctaagctatgagtatgcaaaggcataagaatgatacaatggactttggagacttagggagaaggagtaggaagagggtgagggataaaagactacaaattgtgttcactgtatactgctcgggtgatgggtgcatcaaaatctcacaaatcaccattaaagaacttactcatgtaaccaaataccatctgttccccacaaacctatggaaataaaaattaaaaaaaaaacaacaaaaaatccaaaacacctccaaaattacagctagataggaggaataagttctaatgttttataccactataggatgactatagttaacaataatacatagtttcaaatagctaggaggctattgaatgctcccaacacaaagaaatgataaatgtttgagatgatggatatgctaattactctgatttgatcaccatattacatgtatcaaaacatcactacataccccatgaataggtataattatcatttgtcaatgaaaaaaaattaaaaaaaaaacactaccaaggattaactatctcttttttattttttattttctaactaatcatttattttattttacttatttttaaaacttttattttaggttcaggggtacatgtgaaggtttgttacataggtaaactcgtgtcacaggaggttgttacacaaattatttcatagcccagtacccaatagttatcttttctgctcttctccctcttcccaccctccaccctcaagtagaccccagtgtctactgttcccttctttacgttcatgagttctcatcatttagctcacacttataagtaagaacatgtggttatttggttttctgttcctgtgtcagtttgctaaggataatggcctctggctccatccatgtccctgcaaaatatatgatctcattgttttttatggctgcataatattccttggtgtatatgtaccacattttctttatccatctgtcattgataggcattccatgtctttgctattgtgaatagtgctgcaatgaacattcgcatgcatgtgtctttatggtagaatgatttatattcctctggctatatacccagtaacgggtctaatggtagttctgcttttagttctttgaggaatctccatactgctttccacaatggttgaactaatttacactccaaccaacagtgtataagtgttcctattctctgtaacctcgccagcatctgctatttttgactttttaataatagccattctgactggtgtgagatggtatatcaatgtggttttgattcacatttctctaatgaactatctctttgtaattagcaaagtagttgcatgagaaagaaataaatgaaagttagctaagaaaggactgaaagtttcagagagaattttaattgtaatttatgtttacctggtagtgatatgcaggttgctgataaatgggctgagctaccatcacaggggagctacatacagaacgtgactataaaaggatggaaaaagaaaaattaggcagaagcctttaaaatagctcacaataaaatttatctcaaattattacctaaacccagtaaacttctggtttatgattagaaatattatttttctacctcttattgatatgattaccaactctactaagtctattaaaatcatcacaatatttctacttctacgtggtttcatttccatagtaatgctaaaacaatcaccagaaaagttgtttttagtctgaaatgtaccatctccaaagattatgaaaatatagttataagagaatacttagaggaaaatgacagcaagacttagggtgacgctgcctgtttccattgtggggaccagcaggaaacagttaatgtttataatagtgtttagaactgaatgaatagtcgtatctaattttcccactagttacaaataatcaatgttctattcctttgttatacctataattaaagcaaagatattttatttttattttagtaatttgacatttaaaagagttaatagtttgataaacttacaagtgaaaaatctgtgctgaaaaaagtacaggtaacacttgattattcaaagtgaaagagtaagccccaaaacagattacttaaaaccagatctttaataaaacaggcaagttgtattgcaagatagtaaaactggctctaatgtagcaattaaaattcagtgtctaatgtgggatctaacttatattgttttgtttaatgtttgcacccccgaaactgaggaaaagtatcacagttttgtacaattcacagactatggtatgctaataaaactgtatcactgattaacattagaaaataataatgtaatttcccatattaatagattaaaggagaaaaaatggtaatttcaacagagacagaaaatgcatttgttaaaattccatacctttttatgattaaaaactcttaacaaacatggtagaaaatggcttccttaattgatttagggcagtaactctcaaccatgagtgattttgtcctatagggaacatctggcaatgttgggagacatttttgattatcataactatggggagcctagggatacttctaaacatcctacagtgcacaggacagaccttcacagcaaagaaataatctggctcaaaatgtcaacagtgctaagattgagaaagtctggttaagagtatcttcccacttacaaagtatgcgtgtgtgtgtctatatatgtatgtatacatgcatgcatacatgtaaagtttaatggtgaatcactgaaattgctccctttttcaagaacaaggtcatgatgttttcactacatcaatactgtagcagagacatggtcagtgcaaaaactccaggaaaaaaagaagtgaaagaaatagaagtacactgaatcataaataattgtgtaaatgagagtttggcagggttactgatagattatcactattgaaaaatcaagagcattactatacaccagctacaatctattaggaaatgttatttaaaaaacagcattcattaaagcaacaaaactatagtctactaagaataaatttgacaaaatgtgtcacgcttttttatggagaaagaaaacttttttatggatagaagtaaaataagacaaataaatggagagatgtatcatgttcatggataggaagattcaatattttaaaatactgaaatgtcccaagttattcacactatttaatgcaattctaataaaaaaaagggcttttcactgaactaaacaaactgaattaaaaaatttatacacataaaagcaaagacataaggatagatgagagactcctgaagatgaacaatgtactttaagatttcaagactcgttataaagtcaaaataattacaactgggcaaggtgaacaaatacaccaatggaacaaaatagcagaaaaaagacccacacacatggaaacttagtgtttggcagaggattaatttcaaaatagcaggaaataggtggattagtcgatacataaattcaagatttaagatctagaagtgaaaagtggcaatactatagcattaaaaataaaaaatagcatatattcttgtagtaaaaaacaaaaaactaaaaaagaagaaaaaatcttgtgccagttttcaaagggaatacttccagtttttgcccatctagtatgatactgactgtgggtttatcataaatagctcttattattttgagatacgttccatcaatacctagtttattgagagtttttagcatgaagggctgttgaattttgtcgaaggcctttcctgcatctattgagattaatcatgtggtttttgtcgttgggtctgtttatgtgatggattatgtttattgattcgtgatgttgaaccagccttgcatcccagggatgaagccaacttgattatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattctctctttatctattgattgaaatagcttcagaaggaatggtaccagctcctctttgtacctctggtaaaattcggctgtgaatctgtctggtcctggaatttttttatttggtagtctattaatgattgcctcaatttcagagcctgttattggcctattcagagattcaacttcttcctggtttagtcttgggagggtgtatgtgtccaggaatttatccatttcttctagattttctagtttattggcgtagagccctctctcttcactcctattcaacacagtgttgaaagttctggccagggcaatcaggcaggagaaagaaataaagggtattcaattaggaaaagaggaagtcaaattgtccctctttgcagatgacatgattgtatatttagaaaaccccatcatctcagcccaaaatctccttaagctgataagcaacttcagcaaagtctcaggatacaaaatcgatgtgcaaaaatcacaagcattcctatacacaataacagacaaacagagagccaaaccatgggtgaacgcccattcacaattgcttcaaagagaataaaatacctaggaatccaacttacaagggatgtgaaggacctcttcaaggagaactacaaaccactgctcaacgaaataaaagaggacacaaacaaatgggagaacattccgtgctcatggataggaagaatcaatattgtgaaaatggccatactgcccaaggtaatttatagattcaatgccatccccatcaagctaccaatgactttcttcacagaattggaagaaactactttaaagttcatatggaaccaaaaaagagcccacattgccaagacaatcttaagcaaaaagaacaaagctggaggcatcacgctagctgacttcaaactatactacaaggctacagtaaccaaaacagcatagtactggtaccaaaacagagatatagaccaacagaacagaggcctcagaaataacactacacatctacaaccatctgatatttgacaaacctgacaaaaacaagaaatggggaaaggattccctatttaataaatggtgctaggaaaactggctagccatatgtagaaagctgaaactggatcccttccttacaccttatacaaaaattaattcaagatagattaaagacttcaaatgttagacccaaaaccataaaaaccctaggagaaaacctaggcaataccattcaggatataggcatgggcaaggacttcatgtctaaaacaccaaaagccatggccacaaatccaaaattgacaaatgggatctaattaaactaaagagcttctgcacagcaaaagaaactgccatcagagtgaacaggcaacctacagaatgggagaaaatttttgcaatctacccatctgacaaagggctaatatccagaatctactaagaacttaaacaaacttacaagaaaaaaatcaaacaaccccatcaaaaagtgggtgaaggatattaacagacacttcttaaaagaagacatttatgcagccaaaagacacatgaaaaaatgctcatcatcactggccatcagagaaatgcaaatcaaaaccacagtgagataccatctcacatcagttagaatggcgatcattaaaaagtcaggaaacaacaggtgctggaggggatatggagaaataggagcacttttacactgttggtgggagtgtaaactagttcaaccattgtggaagtcagtgtggcgatttctcaaggatctagaactagaaataccatttgacccagccatcccattactgggtatatacccataggattataaatcatgctgctataaagaaacatgtaaacgtatgtttactgcggcactattcacaatagcaaagacttggaaccaacccaaatgcccatcaatgatagagtggattaagaaaatgtggcacatatacacaatggaatactatgcagccataaaaaggatgagttcgtgtgctttgcagggatatggatgaagctggaaaccatcattctgagcaagctattgcaaggacagaaaaccaaacaccatatggtctcactcataggtgggaattgaacaatgagaacacttggacagaggatggggaccatcacacaccagggcctgttgtggggtggggggaggggggagggatagcattaggagatgtacctaatgtaaatgacgagttaacaggtacagcacaccaacatggcacatgtatacatatgtaacaaacctgcacgttgtgcacatgtaccctagaacttaaagtatataaaaaaaagaaatgcaaaaaataaaaaataaaaaccactaaagcagtactatatgtcatttatgaatacatatatttgtagtaaaaatatataaaatgaataggaaagatattctgcttacttttgaacaggaaagagggtaaggaagtgggggtaaggagaattgacctgaagctgtcttactttactccccattttaagaacttaagtaaatgtggcaaaatgttgatgtctatttaatttggttgatgtgtgttattatttgtaattatctgtggttaagatatttcagaaatataacaaacattaaaaaattgatagtaatagatggaaatccttttttaaatgaaattacttacaggccaaggcggtgggaccgaagttacctctggagtatgaaaataagcaacaccattatggtaagtataaggatatccagttgaagttgttagatacattgttccagctgctggcattatactagaacctaaagcaaagattaaataataataattgaaatgttcaatttaactgttaaaaatgtagtttctaaacacttcagaaaaatatttatcttaatatacctatgtagctatggtaaaaattgaatgtcacagatatttttaaaaaattccttatgtcaaagtatctttgaagcctgtatttttaaactcaataccttaaagcttttagtttaagatgattaaaagaaaagaaaaacaatacgaataagaaataccaaaaatgtatcaattcagattccaacaccagtatgctacacaaagctgaacaatttagactatcatcagcgaagtaattatttgtacaaatataaattatgtataatttaaagttacttcaagacaacatacactgtagtgaagttcctaaggtcttggctagaccttttatttctgaaagtccaaagatgatggaggcagtaaagttggagaagattctactttcctgaagacattttggttccaccctactaattctttggatatcctaccagcaaacattcgttcatgctatggctgtcttttatctctcttttctatgatctattctctatctagtctccctttgctacaactgctgctgttgcaaacatgaccgcaagtcttcatgtggctagtctggggtccccaactcttttcccgggccaagttatataaacccccaccacaaaccaaaaaacagtaaataatatacatagatatatatatattttttgtcattgaggagactttaaaagttaaattagccaaattagattaggtcttaaccagcaaggttatataaattagtgaaactgacaattcttccacctataccagtgcttctcaaaatttcccataaattagaatcacttaaattgttttctaaaatgcaaattccagggacttatcttcagagattttgagtcagtaaatctgggacagggcctaagaatttgcattttgacagcttccaatgaaatgacactgtctgcaaaccacacttcaaatagcatgggcctaccactttaaataatactattgctcctcagcttttatattttcactgcatttgatctagtattgttattatttattttaatggttcttaattagatccttttgagaatttgatgaaaatcagggaccttttcctcagatatatatacagtcaaacacaattttacacacaattttggaggtccatggattccccccaaaagatattccactattattcaaagataatgataatggttcattattcaataatggttcattattcaaagaaaatgaaccatgctttacctgctaaataaataaattttcagtgcatactatttcaaggcattgaacagggccctagtgatacagcaaaaaataaaaaaattagacatgagatggtctgtatcctcaaagaagttaggtctggtagtgaagatagtcattagttgattacacaattaattaattaaatacaattttgataaatacatgaggcattatagggtacgatactgaacatttcaattattatgtatacaaaacatatataaaatttctctctatatacatatatatggaaaatttgtgatgaaatgatgttcagctaagctctaaagaatgaattggatggcaaagtacattctaggtaaagaaaacagtatattagattctgagaacaggagtatagaatgttctggaactgaaagaaggctacatggctaaagcatggaaagaaaagggaagaatacctcaaaataagctgagcataagacaataagaggtgcacttttgaaagatcactctggctgccttgtgaatgatggattggaaggtagaaagattggattcagagagaccacttaggatgtttttccaggaattaaggtaaacaaagtggttagttgggactcgggtgttggtaatggagatggaaagaaatgacagatctaagaaaaaactaagataagaatcccttatttgtaaatgtacttttaacacctatttttcttcgcagaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacatttttaaaacaatgactttatctttttgggattgaattttctatttacaaaaatagagataacaatacatcatgggattctatgaagattaaatgaaaactcataacattgacccttgcactaagtagttttgaaaaaactatttgtatatgtgaaagcattcagcatagtgctgatttattttctatttcagcaactggtagatcatactatgagcattactatttagtacatattgctggtgataatgggctaacggaccgttactatatgttctagcttaacctttgcaagtaacaacagtagattgaaaatattcagcattctgccatatttagtgcattccattttgtattaacctactgaggatactttgattgtctcctaaattaacaaatactaagtcaaaattaaacttaatatacatcaatctcttttttgttgtagttgtggcaactgtattaaccaaatatctattatttctaagtcaaaagcataacagtccaaatgaatacaatctattaatttgttaacagattatatataataacctaatgttttaaacattcccgtagacactaggatgtggctaagggaaaataagttagttataaattttacatcacatttctccttctagccaaagactgttaggaattttaataaatattaaaggtaaaaagttaactataaagatgcctaacttaataagtagaaagagtgaggaaagatagaattgaaagcattagagaaatttgaggaaggtagatacataatttagccaattcctaaagctttagggattgtccccctgaaaattatgacacacctggctgggttacagtacacagcatgcagcgagtttctgatattagttctatgttttcactttcaatatttttactctgattaattttaaattagtttctaattaaaatttttctcattagtaagtctaaattattaaattacttctaattacttttgctatattaaatgatattttcatcacgaaagattttttttcctttaatgatgtaactacatggaatatacttaagcatctttatgtatataaattttttcccagccaaaaaaattgagatatattattttgtggcaaaaatattcagtttttccaccaactttgctaaaataactttattagatgaaagaaacatgatcttttaataaagttctataaaaagtcttatatttcaaaaaagaaccatgcaaaaatatttaaaaatacattagttctcaatacatacgagggatccctacttgttgttttcttattgctggaccaatgttcagcttcttatccttataattaagtttttcagcctaaaataaagaaaaaagaaattattttattattttagcactattatttataaaatcaataaggaaaaactagttagaaagaatttcaaaaattcagactataatattctttcaaagcagcaaggaatagtgggaaagagccgtcttcagactgaaatagatctgggtctgaccgcaattccccattttctccatttgtaatacagtcaatcctcattactcatggattctgtatttgtgaatttgcctacttgctaaaatttacttgtaatcctaaaattaatatttgtggcaattttgaggttattagtggacacgtgaagagcggcggaaaatttgagtagcctgatgcgcatgctcccagttgaggtcaaataaggcgatattctttcttcttgttccagtgctcatactctaagagagagctttctatttagtgccatgttttctccatttttgtgctttttgttggtgatttggctatttaaaatggcccccatgtgtattgttgaagtgctggctagcacaagaagactgtcataggcattatggagaatatatatattagatgtgcttaattcaagcatgaattatagtgctattggccatggcttcaatgttaatgaaccagtaatctgttatatatgatgcctttaaatggaaaaccatataaaacaaggttatatattgataggttgatggcaatattgtgaccagaggttcttgggaacattaccttgtacttcccctagaaagaggagttcagcatttgctaattcagtgttcctagcaatgttagagaacataactgccacaaataacaagaattgactgtatttgattttaataacatacaattcaaattctactttttttctaaaaaagttaaatgttatatttgccttaacttaaagttattacactgaattgctggctataggctttttttctgtgaatattcttagtttatataatgtttttcacaggagggaaatcatctcagataacctcactgttggaatccacatttgtagtgttttttaaacattcaaaatgctattaacacttcgcaaaagatatatccccaagttcttaatttaagtaaataaagcgaaacattatattacagtttcacaaccatacttgtagtgattttggaatttgctcttctgcagattaagtttcctagagaccaatgccaatcttaagatgcaaaccttttttaaaaagcagttgattattgtatttgaaccccgaaaagattagtttcaaatacaaaatttccagaaatgaagttaaatacaccaaaagatcatacctcttgtaaaattttttgtgcatcttcttgtgtttcaaaagtgacgaaaccatacctaaataaatgcattaattattactaattaatcattttcttagaatgttatattaattatattaaaatgtttaaaaattttgtttttaaatcatcggccactgtaggagtaggcatgtttctatgctgcactagcatgggaatcttagaagaatcattcacagcctaacactgtcacttttagtcaggaactaaaagaaaaaaaacccctgagatcttgaaacagcttcagctctcagctgtatgcaggaaagaaaagcacaagagattcatgctgttgcttaaaaattggggatgcaataaatttcaatccagagcaataatctccttttaaactaatagaagtttggctaagagaaatcaaagtagaaaaataactaaaaaatttaaaatttcaacacaataaaatttcttatattggtgaatgacaatgtaaatgtattatttaattattattattagcacatataactgataatgtaattattagtatattcccaaacaatatcaattaaaaatatgtacaacccagatttcacatctgtttttcatacataattaacttcaagcacaattcatataatgttgaagatacaaatacacataaatgatgtgctccatgtccaaaaagccacaataggtagagaaaaaagtaacaaaagaaagaaaaaatgtatctctcaaaacataattgctatttagataacttaagtaaactcttctgagtaatgctaaatatcttcactattttcttcaattcataattactggatcatatacaaagtttcttcttttaaacaaaggaatttctctttatctatttgcccaaacattaaaaagttaaggaattagttttacgctatttttttggtagaacacacacgccacccagtggaaaaggcataaaatacagtttacatttacatttccatgtatgttttccaatgattaaaaaatggtattaccaaaacatagcaaattctgttagtcaaacaaaagaggtaaatctcacttcaccttaatattgtttggcattctgaggaagtatctcatctgtttataaataacctttctgtagaatcccatctcttccagcatatccatctgtcgaatgttgtttctcaccaataccacctcaatgggtcccttttcttatgcctataaatatgtatgtctcgtctctctttcaagaaagtaaatacaatactttactgccttatctattttcttttaactttgcagtccaactccttaagtgagtgtactatgtaaactatctttttcctttctgaaatttggctttgtacacatagcattccactgaaacagctctatacacatttaaagacacagtctattactttcttctcaattttcattatcattgatatagcaattaaaaatcattctcactagaattatatttctcatactggtcccctaattaggtctctgaggcacaacctacagacatttcttggtgtcagctgttttcaaataaagctctctatggcctaaagcagggatacaattccaaaagaatctgattccttttgcttctcattcctcagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatctatagtgatactaaccctttggatactccagctctgtcatttacaatcttcacttctttcacagacccatactgggaaaaaaattttcttaaatcactttcgtttgtctaatggcataaaaagaaaacgttaaaaagcatttttagttgataaaagatgaataattctcatgcttgctctggagacagaaaaagttatagataagatgcatgaaaaatgcctctcatcatcaaaacagtgcataaaccactaggtgattaaaatcaaggtaaatatcttgctttatgcaatagctatgttgttaaattaccatatgccaataaaaatgtaagctgaattattttaaaactacaaaactcactatttaaagaaatctttaaatgattcttgttctctagctggccagtttttaaaaagccaatttggattaggaatgctatttccatagtaagggtacaatactattttggctcttgtggctcagagacagtcatggcagtggaactaggttgtgttggcctacaccagtcattctattttaatcagtagtctcaggaactcctttcctaagtcagttttaggaaaggaatgtatttccaaaagtgcttgaactcaactgtgagaacaatggagtgactataagatttaaagttattagattccttatctgtactcaatatacatttcagctaaattcagacattgttttgataataaaataaaaattggaatcataattagatttaaagcatacaaggtgtctacaaagatggttttggcatgtctgtttttttaattgaaatagtctgataatagactcatatcaccttttctcagaatactgacactaaattcattgcaatttcatttcctggtttagctgtaactgtttgtctacaagagtaacttttctctagaaaaaaatttctttatatacactgcaaaaagacatgccttagtgcagagctatgccttttgagttcaactgccacctcactacttacatacactattggtttttagttggtaacataaagcctgctaagctgcataatgacaaatactgattcaatctaagaaaaactgaatgacttttatttcagttaacagaaaatgaaatcaatgctagaataagaattgttactagatatttgaatacaaattaattccaactattctctggtagaataatcactacctcaattttgtagctccacttctttagtgacaaagagacagtcaagaaaagtaagcattaagagggatagtctgtttgcttataaaaatgaaaggttaaaaagtctgtgactacttgctattaaagtaaatgatttccttgctggcctttatctgtggttttgaaaaaggtataagtatacaggaggaagccctagcaattaccttaaagctatggctgcattataacaaccgtctccaaagtgcatgctgtagctgatgggcttcagtaacctaaaataacctggccatacaaatgtttatatttattgataacttatttttaaaaacatgctaatctattgtaatataaatgaattcccaaattgaacatttctgccagctatcagtattttccacaaagaaaatctttttaaaaataaatattttataagaaataatttttcttactttatttttagtgaaacaatcatatacttgtttaagactcattgttttggcaaatacactaagtgtaacatttctcttgtgcaggaaaaaagaaattccacccaaattgtaacagattggttatatggaaatagttataaatgtcaaatatcacacctaatggcataaggaaggttttttttttgttgaaaatgataactctccctataatttctaatatgtaaaatagaagcttggaaatccttctatatatccatttgaaagtaagagtattccacttaaaatatctatgcatgcctttcttgtaggtgtttactcttacctcccctatgtgggctggggggcactgcacatcatgtcatgaactatgctttcttgaaacagtggaatggctgattacatgatataaatatattagtttttaaaaaacttttattttaagttcggggtacacgtgcagatttgttataaactcatcattggggtttgttgtatagattattttggcacccaggtactaagcctagtaccgaatagttatttttttttctgcttaaatatactacttttaagatgctttattctgacaaggacacaggacttttttggtgatcaaatcctaaattctaacatagaaagtgctttgcaaagaatagatgcctaggaggttgctcaggaatctgagataagagttggggtaaagaaatagtatttcataaaagtaagtttttaaaaaatagagtctcttttgaaaattataataatcaattattttggctattggaatattaggcaagaaagtataattagttctggtatggaagagtatggagctatgagacagaaaactaggcttctagtctcactctgtcactatgtggctagcagcccacagcaagtcagtgaggatcaatttctttatatctgacattgaacagtttttaatgctttatgtaacctacatgctggttgaaaagattctttataataagataattcaaaatctgttaatcattatgcaaatatgttattttatagttgcacaaagaaataatttctgagaaataaagacttctaatgaaaaaatacactttactgcatgcataaataggtaccttaaaatcaattcctcctacaaagatgcgattagggatcactgttccatatcttggggcacttgttgggttattcaaaggcacaggtgacacaggattaggggatggagataatgaatctgtttgcatctggtttgatgtttgctgtaaaataaaattcttttacactttttgcactgggtataatgcagtctgcttttgatgcagaccaaaaacatatatttttcaaaaagaagagtcatttaggcaaaatatagtattctaggctttacttttaatattataaaaattataattagagctaagagctttttaaggcaacagaactaggaaacacagaatctactccactatagagattttaaatattaaatatattacttaaaatgcttatattattatcaaacctattacttaattattaaggggaatattaaactcatgaacatgtttgagaaagagaaaacagtcccagcctgacacaatcaactacaccctggtgttgttaggagttggcctggcactcacagctaggctgtggtgttctcttgttaacagaacaccaacatcagacaaagtcaccctgtgactctgatggatcaagattaaaaacaagaccactccataatcatgtttgaatgctgacaaaaacaaaggcattgcccaaaccacaagaataaccaaacaaccctccattctggctgatatgagtgactgctccttctttatcagctatagttttagcctcgatccatttttctttccttttagataaaagttaacacatccaatcatagaattactaccatttcctgacgctatacattccagagtaaagccctacttccttaaaccctctctagaaattgctcaacagaagcctatatcctgtaagttctaacaccttctgattgagaggccccatggtttatgttttcccttgtttgaacaattaacagacccaactttactaaatgacgcatgtgttcctggtggtctttaactaatggtcatcgacaagttaataaactctaacattcacattcaccattttcagcctgaaagtcaaaattttaaatgcacttgtcaatttgaagattggactgattttgttaaaaaattatatacttgtagctcataaatgtttattccaaagaattagctcagtacatatccacatgttcacaattctaagttagaggacataatttaaattttaataaatatatataaatgtataagcctttgcagaatggtaagataatagacttttaaggtataactgaaaaaaaacccaagacttgagaatcacattgaagagaaaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgatt

SEQ ID NO: 990 - DNA, 59337 bp, Homo sapiens
caaaattccttatccaataatacataattaatttttattaacagtccaggatttgtttagcatcttgtttaacatttgaaaatcaaaacataaactttttggttctcaaggatagtgctattaaaagaaaatcttgaacatcagtggttagtaattttttacttacagaacaaaaacttctgaaatttcattgtgggacttaatctatttacattcctaaaactgagaataattaatgtatttgagatccttgtatgctagtatacattcataaggttctactgttctcatgaagccatttgactggcaaacatattcattacagtttcaaaagaaaacaccctatttgactcaccagaaaaacctttgtgatctatatcctactatttctgctgctgctgctgagcatggaatacatgtggggttgaaacaggggaggaaagagatagatttattagggtaataccaacttttatggctccccctgccccctccacctaaaattaggaggtcagtgaaagaactgcaaatgaatgtaaagaggaatatttcctgtactactgtagaaattttagagattaaaaacccctatgatttgttctgtaccttttgaacaatgaatgacacccctcccatctattttccaattttatagtaaaaatcggatttagaatcagaatctaaaattttcctttggtgtaaaaaatagttttgcattttatgaaaacaattgtccttttaaaaattaatcacatatataattgaatatattggttgcatatcagaagaaaaggtttaaggattaaagcattcaaagaacagtaatttggtggaatttcagtcagtgttatgggatcatgtcagagatgaacccttttatcaaaattccaaaggtggatccatattttataaaatttgataccaaataaattatgttataggaagatttcaatattgtctcaaacactggagaaaaaatttaatatagtcaaattacatgaaaaggcaagaatactgatcatgttgatggtatttctaatatttggaaaatgttataaaaaagaagtataaatactattcagattctgaaaaccatggcagacgcaaaattaaataaggagtaacagtaataaatgaattaaaaattagacaaaagcatattaaatgacaaaacagcaaagcaaaaatagaattgtcattaatattaaatagtatactgttgtaaaatatatgaaagtattaaaagtattataattaaaaatgattcttatcctaaatatgaaaataaatatcaaataatatgaaacataacatctaattgtttgataagaaaaaataacacaaagcagagaaaataaaagacacctcactattcccaatgtggttattatttatggaatggataaaacatgttgtagaaaaggtcattacagttaggttagcacataaaaaaccaacatgccacatctacctaaataattttgtagaacagctgaaaaagcaaatttcatcaaatttagacagcttatagtggaataactgagtatggtgaggtattaactaacactaagtttcacaacgggcagcttctagctggttcgttgaagctggatctcggccacgcaaggatcattggacaagaaatcagttgagctggaatagagctgcccaattgtcttaataatgaatgctccacactgtctgttaagtaaagagaaaatatagatcaggaagactgaatggaaaaaaaaagataagttagaacagatgagtacagaccatcaatcaacattcactaaatatttgcagaaccttggtaccaattaaattagaatgttacaaagtgagaggctagcaatttaggagggctccagaactcaggaaaacctgctctctgagagcttagaatctatattagacaatctctagtctagtgttacagtataaatgttgagtaaataaaatgagggatgggtcagcacagattacgagttacaacatttccttctattaggtgggtcttaaaaacttgtttttaaaaggggaatagtatttttggcaggaggctatttagaacgctgtccaggggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgtgcaccgtgcgcaagctgaagcagggcgaggcattgcctcacttgggaagcgcaaggggtcagggagttccctttctgagtcaaagaaaggggtgatggacggcacctggaaaatcgggtcactactgcgcttttccgacgggcttaaaaaacggcgcaccacgagattatatctcgcacctggctcggagggtcctacgcccacggagtctcgctgattgctagcacagcagtctgagctctaactgcaaggcggcagcgaggctgggggaggggcgcccgccattgcccaggcttgattaggtaaacaaagcagctgggaagctccaactgggtggagcccagcacagctcaaggaggcctgcctgcctctgtaggctccacctctgggggcagggcacagacaaacaaaaagatcagtaacctctgcagacttaaatgtccctgtctgacagctttgaagagagcagtggttttcccagcatgcagctggagatctgagaacgggcagactgcctcctcaagtgggtccctgacccctgacccccaagcagcctaactgggaggcaccccccaccaggggcacactgacacctcacagggcagggtattccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgtctctcctcctccaaaggaacgcagttcctcaccagcaacagaacaaagctggatggggaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgaagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttgagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcttttacagacaagcaaatgctgagagattttgtcaccaccaggcctgccttacaagagctcctaaaggaagcactaaacatggaaaggaacaaccggtaccagccgctgcaaaatcatgccaaaatgtaaagaccatcgagactaggaagaaactgcatcaactaatgagaaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccacctcacttgcagagacacacataggctcaaaataaaaggatggaggaagacctaccaagccaatggaaaacaaaaaaaggcaggggttgcaatcctggtcttggataaaacagactttaaaccaacaaagatcaaaagagacaaagaaggccattacataatggtaaagggatcagttcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaacagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaactgctcaaatacatggaaactgaacaacctgctcctgaatgactactgggtacataacaaaatgaaggcagaaataaagatgttctttgaaaccaacgagagcaaagacacaacataccagaatctctgggacgcattcaaagcagtgtgtagagagaaatttatagcactaaatgcccacaagagaaagcaggaaagatacaaaattgacaccctaacctcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgagcccacagaaatacaaactaccatcagagaatactacaaacacctctacgcaaataaactagaaaatctagaagaaatggataaatttctcgacacatacactctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaacaactggtaccattccttctgaaactattccaatcaatagaaaaagagggaatcctccctaactcattttatgaggccagcatcattctgataccaaagccaggaagagacacaacaaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaagactggttcaatatacgcaaatcaataaatgtaatccagcatataaacagagccaaagacaaaaaccacatgattatctgaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacggggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaggctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaagaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatagagaccaatggaacagaacagagccctcagaaataatgccacatatctacaactatctgatctttgacaagcctgagaaaaacaagcaatggggaaaggattccctatttaataaatggtgctgggaaaactggctagccatatgtagaaagctgaaactggatcccttccttacaccttacacaagaattaattcaagatggattaaagacttacatgttagacgtaaaaccataaaaaccctagaagaaaacctaggcaataccattcaagacataggcatgggcaaggacttcatgtctaaaacaccaaaagccatggcaacaaaagccaaaattgacaaatgggatctaattaaactcaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaaccagttcaaccattgtggaagtcagtgtggcgattcctcagggatctagaactagaaataccatttgacccagccatcccattactgggtatatacccaaagggttataaatcatgctgatataaagacgcacacgtatgtttatcacggcactattcacaatagcaaagacttggaaccaacccaaatgtccaacaatgatagagtggattaagaaaatgtggcagatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaaaacttggacacaggaaggggaatatcacacagaggggactgttgcgggtggagcggggagggatagcattaggagatatgcctaatgctaaatgacgagttaatgggtgcagcacaccaacatggcacacgtatacatatgtaatgaatctgcacgttgtgcacatgtatcctaaaacttaaagtataataataataaaattaaaaaaaagaattctatttaaagtctgcataatgaaaaatgaagcagaaaattactgcaaaaatacactgtacattcttacaaagtgaaccattgagataactatttccaggttacatgatacatttgaggtaaaagttactgtaaaatttatttaaaaaaatggataagatcaaggggaaatgtgatctattttctctctttagaagcttttggaattttttctattattcctgccattctgaaatttcacaataattggccttagtgtgagtcttttgcagtaattgtggcaagtagttggtaggccttttcaatttagagactcttgtccttaagtttctaggaagttttcttctattaatttattgataatttcctccaatgatttttctctattcctctttctgcaatttaaaaaatatttgacttctgggattaatctaattttatcttttctctattattattcacctcagtcttttttgattctacgttctgaaaacttttgcctgtaatatttaactcacacataatttatttcaattatcacattagtggaaaaactagtgacattttagaataaggtgtatagtttagacgactgtactgatgttcatttcctgtgcctgtgccctctagccaaaggatgaagtaggtgaaggatatacagaaactctattatttctataacttctcagtaaatctgaaattatttcaaaatgcaaggctaaaaaaattaaaaggacagatatttgagagaaaaagtatcaggctgtctatgcatgtcccacttctcattagtttttgcctgtttcggagaggatattaattgtagtttctttgatattttcttctgctccctgcattgtatgtttcttatgaatttctttttttctgtttattttgttctctcaccctagaggttttcttctaacgtggctgcacgtcatagttaagagggaggcactaaaatcctaatgggaagttctttgtgcatggtttgtcagtgatcttcacttcaaggatttaagagaccatcgaactttttctctgtggtagaaagcatgcttggattagaatcctggatctgccacttactcaactatgctactgtgggcaagttactttttaagcttaaagtgatcaaattaacactgccagtaattagacatattggcatctcatatcccctgatatgacacactgataagggcatatcacctctgtgatattattgtcccaaattcataccctttatctaattaagagaaaacataggccaacaaaagtgaagagtgttctacaaaataactaatcaatattttaaaaaagaatcaaggtcatgaaagacaataaaagactatgtaaatgtcacagattggtggagaataaggagacatgacaaattaatgtaggatcttagattagatcctagaacagaaaaagaacataagtgaaaaaaatggtgaagtttgtagttcacttaataggtctgtagtttacttaacagtactttatgaatgctaatttcttcgttttgctaattgtttcaattataagctgttagaagttgagtgaagagatacatgaactctatgtattatttttacaacctttctgtaagtgtaaaattattttaaaataaaatgttaaaaaataggttaaaaggccaaggacatttggtgggatgggatgatgggggaggataactgccaggatatctatgcatgggttgcttctcattaattttgcttgaggcatgatgaatccttttttgatttgtaaattcaagtcacagtgtttttgattttgttttgctgttaaaatttctgcacattctttctgttccatttattctgtattcttttcttgagaattactatttttttggttggacctgtctctctgctctctctattctagcattttatctcatcatttaatctttcatgttattttcttttacattctggaagaattaaaaatatccctctctatgaaggatttcattttcttttgtgactactggccctttatgacaaaggcaaatatgattctttccatcatgtcaatagtttttgggcagtattttcttacactagccagcaaccatttcatttttcctgtttttcagcttgcaattgtttcttaaagatctattactgagaacatgggatacatcttaaaaattgtatttaatttcctctaatacatacgttcttatacatatatacatatttatactattcatccttgccttcaatgtagtgccatattcaattttttttcacagaatccatataatacatacttttctgtttactcatccttgaatggggatctactcatgacaattagaattggtgtcatgaacacttgattctccttactgtccttacatcaaaaaggagtcttggtagacacagaacctatacaatttctaatgtctaagtgggtgagcattttttgctcctcctgcctagttctttatgagtaaaaaacttattctagagaatctgaggctgtctattgtttgactatatatagcatacatgaaaatttataccctccttatatattcagagcttttcctgcctctgtcctctagattacattgctttatacttgtccttcccaggtttttcagaatacaagacaatttgagtctctaaattgattcataagtattaatgatactcaaatgaggaaatggttgggaaaaaaatactggtagtggaatctttttgtaaagcagatatagttgctaatttttaggtaagtgcacgctctgggcctctgaactagaagtagatagtggtagtagttcagatccctctccaatttacttctgaatcatactttgtcgaccattagttgtgtttttcatttaagtccaatcagtattttacttagaagaaattccttatagcctgggcaagaggttaaatatgatccttaatagccatatgttttcatcgattgttagtagacatgggagttaaataaaatacacattgaacttaatccatataagaacaattttattagatgcttatattaatgcaaaaatgtaaaaacactgtaagaaaaccaaaacacttgagaattctccacttatacccttcataccttgggatttgatatttatcttagaaacataatagttcacatacccagaaacacagattttccttttgttccttcctagtctagttcagtgggataattttgacattatgtggttttgctttttttgactttaaaacttaattctcttttatttcttttttaaaattagagatggggtctcgccatattgccaggctggccttaaactcctggctcaagtgatcctcctgccttggcctcccaaagtgctggggttcaggtgtgagttaccacacctggcctaaaacttgattctgtataagatgttactgctgaattagggaatgatggccctaattagtattatattaatctagttacctctatattggtctgttttgtatttattcgtttttgtatttgatttgacagagtatgtaggctgtggcttacagccaatgagtagtttctggtaaacagtacttcacagcagttagacttgtgcttcaaactctgcataaggtttctattttatggaatagatttgttgcttcaagataattttgacatttgaaattcctactttgggatatcttcaattaacattcatgagttgtaatcattagagctttaaaaatgagttttacgcttataaaaacaacaactcctccaaagaatatttccacctttctattttaaaagtcaccaagatttttggtactagagaaaatttgcattggaagtaaaaaaaggctaatgtttcaaatgtcattcactaatattttaatattagtaatatgttctagaaaaagattgtttcataatgtagaacaacatttgtatattaagatttccatgttataatagaaatgcactgtaaatgaaaatagataatttgccacatagtaatacatgcatattaaagcatttctacagcattatatagttctagaaaactacagaagtggttttggagtttctgtctctgagtggggtatcgttttgtattgagggccactaagtcacctaaagaaaaatattgagtataaaatgcatagaacatttaatcttaaaaaataaaaatgagaaacacaaaattctacataactatcttgtgctccagttttgactttggaagtctatttttttccatctctaacaaaagaggaattggtaattattattatttttttattttagagatatacatggtttcactctgttgcccaaactagaatgcagtggcgtgatcatagctcactgtaaccttgaacctttgggctcaagtgatcatcctgcctcagcctcctgagtagttagcactataggggtgcaccaccatgcccagatagtttttaaaatttttattttgtagaggctgaggagttagcactataggggtgcaccaccatgcccagatagtttttaaaatttttattttgtagaggcagggtctcactatgctctcaaactcctggcttcaagcaatcctcctaccttggcctcccaaagtgctgggattgcaggcatgagccaccacagttggccagaattggtaatctttatatgactatattaaagagtaagataccagtttctctgtacaatttctgatgttacctactcacagatctaagaacatttagagaaatatatactcttaaactagaagaattaaattttaagaatgtttaacattaacatcctttggaaatttctcctatccaaataccacccaccactccatcctctattcaaattattcaatttgtataattgtataaattacacaatttccatcactttgtgatatagctctctctcagtaactgaaaataactatcacttacataatatggcatagcaacatcagccatttctgcaaaagtatatttggagtaaatgttaacgacagaagaagtctattttagaagattttctaacaatactaaaaatgaagcctctatgagtaatgtttagtaacactataggttttgacaatatgtcaaaattatggttttatttcatgtttggtgtatagtgataaagccaatgaagggatgcagtgagtggtaatggcagtgagtggtaatggtgtgaagggtcacgagaagaccgggaggctccttaaagtagactgtcttggtattgagttcaacacataggatgggccagaacataaatatgagtgtgaaatagctaatatccattattttaatgcaaagactatgcctaccttcctcaccaaagtacactgtatgcaggattcatattaccatctcaacagttgatcagtctgtggctctttactgcagataaagttcatttccttaaagggatgatgcaagagtttcaccaagaaacttgttcataagggaataggaagaattccctgtacatagtagatagtcaaaatatattgagtgtatacatgggtataactggattatcattctttggcctgaatctgactaaggaggcatgaacatggttcccaaactggaaaaggagatcattaattgttttcacctccccataaatgtcacatgtcatcaacatagataataaaaatcagagtactgtatattaaatatctagaataggcaaattcatatagatagaaagtaaattagaggttaccagggactaggggttgagaggaagcacataggaagagttattgcttaatgggtgcacagagtttcaacttgggatgaggaaaaggtttgaaaacaatggtgatggttgcatagcattgtgaatgtaattaatgccactgaattgtacacttaacaatggttgaaacagaaaatttttaagtttgaagtcaggtagcgtgatacctccggctttgttcttttggcttaggattgacttggcaatgagggctcttttttggttccatatgaactttaaagtagttttttccaattctgtgaagaaagccattggtagcttgatggggatggcattgaatctataaattaccttgggcagtatggccattttcacgatattgattcttcctacccgtgagcatggaatgttcttccatttgtttgtatcctcttttatttcattgagcagtggtttgtagttcttcttgaagacgtccttcacatccctcgtaagttggattcctaggtattttattctctttgaagcaattgtgaatgggagttcactcatgatttggctctctgtttgtctgttattggtgtataagaatacttgtgatgtttgtacattgattttgtatcctgagacttttctgaagttgcttatcagcttaaggagattttgggctgagacaatggggttttctagatatacaatactacaaggctacagtaaccaaaacagcatggtactggtaccaaaacagagatagagaccaatggaacagaacagagccctcagaaataatgccgcatatctacaactatctgatctttgacaagcctgacaaaaacaagaaatggggaaaggatcccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagccatggcaacaaaagccaaaattgacaaatgggatctaattaaactaaagagcttctgcacagcaaaagaaactaccatcagagtgaaaaggcaacctacaaaatgggagaaaattttcacaatctactcctctgacaaaggatatctctaatatccagaatctacaatgaactcaaacaaatttacaagaaaaaaacaaccccatcaaaaagtgggtgaaggatattaacagacacttctcaaaagaagacatttatgcagccaaaaaacacatgaaaaaatgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacaatgttggtgggagtgtaaactagttcaaccattgtggaagtcagtgtggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaacgatagactggattaagaaaatgtggcagatatacacctcggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacactccggggactgttgtggggtggggggagtggggagggatagcattaggagatatgcctaatgctaaatgacgagttaatgggttcagtacaccaacatggcacatgtatacatatgtaacaaacctgcacattgtgcacatgtaccctaaaacttaaagtataataaaataaaataaaataaaaattttttaaaaaagaaaatttttaagttgcatatattaccacaataaataaaaaagttaatagttaatttagaattatatttccttcacatgagtttgctaattctgtacttctgatcacaagtgtgatgtaaatatccaaaattgttcctttctagaagagaaagttggaaaacttgaaatatgatggaagaaaaacaaagtaaaaagtcaaaacaaatttcttactttaattggctcaggctgcatcacaggcgcaggcatagtgatggcacttggagcataaacctggtgatatgttgcttgaactccatgatcagaataaggctattacaaaaaaagagagaaaaaatgtcacctttcatctattaattctaaatatttactcagcatttacaatatactaatcatctagctatacaatgtagaaacagttaaaaacacatgcccttatgtttaattaacttataatctgatgagttaatataatgaattaacttatgaattaacttgtaatctgatgagggaaatagacagtagtcagaatgatcataaatcctatagacatgtatagggatgcaacaggcaagggaagagattatgtaaatgcagttatggcttgtccagcagatggtggtaccattcattggaatatagaatacaaggaaagcttaatattcatgtaattgtgtgtaaggggttgcagagcaggagttaggtttgtgatatacaaaatttgtggtatctgtaggaattctagtagacgtatactgttgatagatgtggctctagaccaggactgtcaaatagaaatacaatgtgagctacatatgttatttaaaattttcccattgtcatgttagaaaaataaaaaatggtagaattaatttttagtaataccttttatttaaactaatacatattaaatattatcatataaaagtacaatcaatacaaacattaccaagatgttttacattcttttttcttttttttttgagatggagtcttgctgtcttccaggctggagtgcagtggtgtgatctcggctcactgcaagttccacctcccggcttcacaccattctcctgcctcagcctcccaagtagctgagactacaggtgccgccactacacccggctaattttttgtatttttagtagagacggggtttcaccgtgttagccaggatggtcttgatctcctgacctcgggatccacccgcctcggcctcccaaaatgctgggattacaggcgtgagccattgcgcccagctacattcttttttcacactgtgtcttcaaaacccagtatgtattttacacttaggggacatctcaattcggtcttactgcatttcaagtgctcaactgccacatgtggctagtggctattgtagtggatagtgcagtctaaaactcaggagtgagacggaggctagatatatggctatggatgataacatcagagtgagtacatgtggtgaaagaatggagaatcaaatacaaaatctgcttataaaggaaaacaaaaggaggtaaaaggattgccagaagagagtagtatcatggaaaccaagggtaggaagagttttagggagtaggtacaatgtctctgagaggtcaaataagataaaaaagaaaggaaagtttgtgtcagttaggaagtcattgaggacctttacccaaggcagcttcagcagaaaggtaatgaagtagacttcagcaggtgaggagtgaatgagtagtgaagtagcagaaattctgaatgtagactactttttcaagacacttggctttggaaggtagcagaaaatcagggaagtggtgggagtgtgtgtcacaggataatattgcctcttacaaggtgctgcacactatacaaagaactttgtataccatctctctagtctttacatcaatcctgcaaaatagtttttcctgatgtcctcattttacaaataaggagattatgaaagcaagaccatgaagggttaagcaattcctcaaagtaacacagtaagttgtgaagctgtaaaccagtggagagaagaagacttcaaatacaagacagaaaaagaacagtagatggaatgaggtccctgaggaggagggaactgatagcatctagatcgcaagaggcagaaataaccttggacaagactgaaagtcactaaataaatataagaagctaaggatgagttacgatacaggtaaagtttgtgtttcaggggttggaggctgagttggttttcacaaattggttcttactctgcaaaagagaaggcaaagctatattctcagaatgacatgggcaggcagtggagtgggtgcaatctggtagtactgagggcttggcaaaggtttaaaataatcattgaaataagtgagtgaagacggtcacttttttttttaaaaaaagaaatttgactataacactcacaagaaaagtcgtgaagttcttaattttagggaaaaaaacacttcaactgtaaaccatcccactctattcattaagttatatattagtcagactataccctctactagaaacagtagcaaaacaaaaacatgcaaatattttgtatggaaataccacacaaagtacaagttataagataatgatgggcaatattttcagaaaagctttattagattccattaaatagtgcatatattctgatggtaagtatctgatatcagatattaaaaatatgatttaatgccaaaagagattctgacaaaaaatcaaatgtaaaagcattcttatctcactacctgctcctggcaaaccagaaaacaacaaaaagaacaaaatatagatttttaaaatgccatcatcaattaaagaagaaaatgcctatgactcccaaaccatacacaatgtagaatgtctgccaagtgctgtgcaagttggacgaacataagggaggattctgaagcctcctcagtcatgagaaaggatgacgatttcccaagaggtcaatgttctggaagacctcctcaaagatactttagagtcttgagtgcagaagtatgtattggtcagagtgaggtagaagcacaaaatatctccacagagatcctattcataattaggataataattaataataattaagaatcctgacttaacaggggaggtagaattgatggagaaatcatgtttatataatttttcttgtctactatctagccttttacctgaggaatactgctggaggtgaagcagggagaaagtgggaaaggaagtagcaattgccacatcccaatacagaacccctgtgataaaaagggctttacaaggaacaaaaatgatctctggcaaggatgtggaggaaagggaatccttgtacactgctggtgggaatgtaaattagtatggccattttggaaaacagtagggtggtttctcagaaaattaagaatactatcatgtgatctagaaatcccactactgtgtatacatatccaaaggaaatgaagtcagtatgttaaaaagatatctccatttccatgttcactccagcattattgataatagtcaagatatggaatcaaccttagtgtccatcaatcagtgaatggataaagaaaatgtagtatccatatacacaatggaatactgttcagccttaacaaagaaggagatcctgtcatttatgacaacatggatgaacctggaggacattatgctaagtgaaataagccaagcacagaaagacaaatactacatgatttcacttatgtgcagaacgtgaaaaagtcgaactcatagaagcagagagggccaggtgcggtggcttatgcctgtaatcccagcacttttggaggccgaggcaggcggatcatgaggtcaagaaatcgagaccatcctggccaacatggtgaaaccccgtctctactaaaaatataaaaattagcccggcatggtggtgtgcgcctgtagtcccagctatttgggaggctgggacagggggatcgcttgaacccgggaggcagaggttgcagtgagccgagatcatgccactgcactccaacttggtgacagagtgagactctgtctcgaaaaaaaaaaaaaaaaaaagcagagagaagaatggtggttgccagggactggggatggcgagtgagatgggagatgttggtcaaaggttacagggtttcagttctaaaggaagaatatgccctgaagatctactgtatagcatgactatagttaataataacatattatatacttgaaaattgctaagacttaaagtaccttaaatgttctcaccacaaacaaaaaaaaggataaccatgtgaggtgatggattagcttgattggggtaatcatttcacagtgtgtacatatatccaaccatcatgctatacactgtaaatgtataccatttgtcgttagttacaatttagtaaagctgaggataaaaagaaaaaagcaaccataaaaaagtaggtggggcaggccaggcgcagtggctcacgcctgtaatctcagcactttgggaggccgaggcaggctgattacgaggtcaggagattgagaccatcctggctaacacggtgaaaccccgtctctactaaaaatacaaaaaattagccagacttggtggcacacgcctgtagtcccagctacttgggaggctgaggcaggagaatcacttgaacccaggaggcagaggttgcagtgagccgagatggcaccactgcactccagcctgggcgacagagcgagactcgggctcaaaaaaaaaaaaaaaaaaaaaaaaggtggggcatgaaacaaataataaagaaatcctagtaaaagtattgatagtaaatcttaagatccaactgtggaaattattgtttcagaacaaaattataatattaaaaaagtaataaaacaatgtacttaaactgggaggtaaatgctaatttcttaatctttcaccacactgatttaaaacataccatgcacatggtactggtacaaaaacacagaccaatggaacaggatagagaactcaaataagaccacatatttacaaccatctgattttcaacaaacctgacaaaaacaagcaatggggaaaggattccttgtttaataaatggtgctggggaggtccagggcaagatggccaaataggaccagctctggtccgcagcttccagtgagaacaatgtagaaggtgggtgatttctgcatttccaactgaggtacccagctcatctcactgggactggttagacagtgggtgcagcccacggagggtgagcagaagcagggtggggcgtcacctcacccgggaagcacaaggggtcagggaactcccttccccagccaagggaagccatgagggacagtgatatctggctcagatactacgcttttcccatggcttttgcacctgcagaccaggagatcccctcgggtgcctacaccaccagggccctggatttcaagcacaaaactgggtgcccatttgggcagacaccgagctagctacagggttttttttgttcataccccagtggcacctggaactccagagagacagaaccattcactctcctggaaagggagctgaagccaggagccaagtggtcttgctcagtggatcccacttccatggagcccagcaagctaagacccactggcttgaaattcttgctgccagcacagctgtctgaagtcgacctgggatgctcaggcttggtcaggggttggggcatctgccattactgaggcttgagtaagcggttttccactcacagtgtaaataaagccactgggaagttcggactgggcagaacccacctcagtactgcaaagccactgtagccagactgcctttctagattcctcctctctgggcagggcatctctgaaagaaaggcagcagccccagtcaggggcttatagataaaactcccatctccctgggacaaaacacctgggggaaggggcagctgtgggtgcagcttcagcagacttaaatgttcctgcctgccggctctgaagagagcaacagatctcccagcacagtgcttgagctctgctaagggacagaatgcctccttaagtgagtccctgacacctgtgcctcctgactgggagatacctcctagcaggggttgacagacacctcatacaggagagctccagttggcatctggtgggtgtccctctgggacgaagcttccagaagaaggagcaggcagcaatctttgctgttccgcagcttccgctggtgatacccaggcaaacagggtctggggtggatctccagcaaactcctacagacctgcagcagaggggcctgactcttagaaggaaaactaacaaacagaaagcaataacatcaacatcaacaaaaaggacatccacgcaaaaaccccattcacaggtcatcagcatcaaatatcaaaggtagataaatccacaaagatgaggaaaaaccagcacaaaaaggctgaaaattccaaataccagaatgcctcttcccctccaaaggatcacaactcctcgccagcaagggaacaaaactggacggagaatgagtttgatgaattgacagaagtaggcttcagaggtgggtaataaactcttccgagctaaaggcgcatgttctaacccagtgcaaggaagctaagaaccttgataaaaggttacaggaactgccaactagaatagctagtttagagaaaaagaaaagtgacctgatggaactgaaaaacacagcacgagaacttcgtgaagcatacacaagtatcaatagctgaattgatcaagcagaagaaaggatatcagagatggaagattgacttaatgaaataaagcgtgaagacaagattagagaaaaaagaatgaaaaggaatgaacaaagccttcaagaaatatgggactatgtgaaaaggccaaagtttaggtttgattggtgtacctaaaagtgacacggggaatggaaccaaggtggaaaacacactcaggatattatccaggagaacttcctcaacctagcaagacaggccaacattcaaatttagaaaatacagagaccaccagaaagatactccttgagaagagtttggtgggaagcccaccaaactaacagcagatctctctgcagaaaccttacaagccagaagagagtagcggccaatattcaacattcttaaagaaaagaattttcaacccagaatttcatatccagccaaactaagctttataagtgaaggagaaataaaatcctttacagacaagcaaatgctgagagactttgtcaccaccaggcctgccttacaagaattcctgaaggaagtactaaatatggaaaggaaaaaccagtaccagtgactgcaaaaacataccaaaatgtaaagaccatcgacactataaggaaaccgcatcaactaatgggaaaataaccagttaacatcacaacgacaggatcaaattcacacataacaatattaacttaaaaggtaaatgggctaaacgccccaattaaaagacacagactggcaaattggacaaagagtcaagacccattggtgtgctatattcaggagacccatctcatgtgcaaagacacacataggctcaaaataaagggatggaggaatatttaccaagcaaatggaaagcaaaaaaaagcaggggttgtaatcctagtctctgataaaacagactttaaaccaacaaagatcaaaaaagacaaagaagggcattacataatggtaaagggatcaatgcaacaagaagagctaactatcctaaatatatatgcacccaatacaggagcacccagattcacaaagcaggttcttagaaacctacacagagacttagactcccacacaataataatgggagactttaacaccccactgtcaatattagacagatcaacgagacagaaaattaacaaatatagtcaggacttaaactcagctctggagcaagaggacctaatagacatctacagaactctccaccccaaatcaacagaatatacattcttctcagcaccacatagcacttattgtaaaattgaccacataattggaagtaaaacactcctcagaaaatggtaaagaacagaaatcataacaaacagtctctcagaccacagtgcaatcaaattagaatgcaggattaagaaactcactcaaaaccacacaactacatggaaactgaacaatctgctcctgaatgactagtggataaattatgaaattaaggcggaaataaataggttctttgaaaccaatgagaacaaagacacaacataccagaatctctgggacacagttaacacactgtttagagagaaatttatagcactaaatgcccacagaagaaagagggaaagatctaaaatggacaccctaacattacaattaaaagaactagagaagcaagatcaaacaaattcaaaagctagcagaagacaagaaataactatattagagcagaactgagggagatagagacacgaaaaacccttcaaaaaaaatcaatgaatccaagagctggttttttgaaaagattaacaaaatagaccactagccagacggataaagaagaaaagagagaagaatcaaatagacacagtaaaaaatgataaaagggatatcaccactgatcccacagaaatacaaactaccatcagagaatactataaacacctctacacaaataaactagaaaatctagaagaaatggataaatttctggacatatacaccctcccaatactaatccaggaagaagttgaatccctgaataggccaataacaagttctgaaattaaggcagtaattaatagcctactaaacaaaaaaagtccaggagcagacagattcatagccgaattctaccagaggtacaaagaggagctagtaccattccttctgaaactattccaaataatagaaaaagagggactccttcctaacttattttgtgaggccagcatcatcctgataccaaaacctgtcagaaaccaacaaaaaaaaaaaaagaaaatttcaggccaacatccctaatgaacatcgaagcaaaaatcctcaataaaatactggcaaaccaaatccagcagcacatcaaaaatcttattcagcaccgtcaagttggcttcatccctgggatgcaaggctggttcaacatatgcaaatcagtaaatgtaacccatcacataaacagaaccaacgacaaaaaccacatgattatctcaatagacgcagaaaaggccttcaaaaaaattcaacaccctttcatgctaaaaacacttaataaactaggtattgatggaatgtatctcaaaataataagagctatttatgacaaacgaatagccaatatcatactgaatgggcaaaagctggaagcattcccttgaaaaccggcacaagacaaggatgccttctctcatcactcctattcaacacagtattggaagttctggccagggcaatcaggcaagagaaagaaataaagtgtattcaaataggaagacaggaagtcaaactatctctgtttgcagatgacatgattgtatatttagaaaaccccatcatctcagccccaaaactccttaaactgataagaaacttcagtaaagtctcaggatacaaaatcaatgtgcaaaaatcacaagcattcagcattcctatactccaataatagacagagaatcaaatcatgagcaaactcccattcacaattgctacaaagagaataaagtagctaggaatacaacttacaagggatgtgaaggacctcttcaaggagaactacaaaccactgctcaaggaaatatgagaggacacaatcaaatggaaaaacattccatgcttatggataggaagaatcaatattgtgaaaatggccatactgcccaaagtaatttatagattcaatgctattcccatcaagctaccattgactttcttcacagaattagaaaaaactagtttaaatttcatatggaaccaaaaaagaggccatataaccaagacaatcctaagtgaaaagaacaaagctggaggcatcacgctacctgacttcaaactatactacaaggctacactaaccaaaacagcatggtactggtaccaaaacagatatatagaccaatggaacagaacagagacctcagaaataacatcacacatctacaaccatctgatctttgacaaacctgactaaaacaagaaatggggaaaggattccctatttaataaatggtgtcgagaaaactggctggccatatgcagaaaactgaaactggacctcttccttacaccttatacaaaaattaactcacgatggattaatgacttaaatgtaagaactaaaaccataaaaatcctagaagaaaacctaggcaataccattcaggacataggcatgactaaaacactaaaagtaatggcaacaaaagccaaaattgacaaatgggatctaattagactaaagagcttctgaacagcaaaagaaactatcatcagagtgaacaggcaacatacagaatgggagaaaatttttgccatctatccatctgacaataggctaatatctagaatctaaacagaacttaaacaaatttacaagaaaaaaacaatcccatcaaaaaatgggtgaaggatatgaacagacacttctcaaaagaagatatttatgtggccaccaaacatatgaaaaaaagctcatcatcactggtcattagagaaatgcaaatcaaaagcacaatgagataccatctcacgccagttagaatggcgatcactaaaaagtcaggaaacaacagatgctggagaggatgtggagaaataggcatgcttttacactgttggtgggagtgtaaattaattcaaccactgtggaagacagtgtggcgattcctcaaggatctagaaccagaaataccatttgacccagcaatcccattactgggtatatattgagaagtttataaatctttcttctataaagacacatgcacatgtatgtttattgcagcactatttacaatagcaaagacttggaaccaacccaaatgcccatcaatgatagactagataaagaaaatgtggcacatacacaccatggaatactatgcagccataaaaaagaatgagttcatgtcctttgcagggacatggatgaagctggaaaccagcattctcagcaaactaacacaggaacagaaaaccaaacactgcatgttctcactcataagtgggagttgaacaatgagaacacatggacatagggaggggaatatcacacaccagggcctgtcagggggtcgggggcacggggagggatagcattaggagaaatacctaatgtagatgatgggctgatgggtgcagtaaacccccatggcacatgtatacctatgtaacaaacctgcacgttctgcatatgtatcccagaatgtaaagtataataaaaaaaaatggtcctgggaaaactgtttagccatatatagaaaattgaaactggacccgttccttacaccttatacaaaaattaactcaagatggattaaagacttaaatgtaaaacccgaaactatagaaaccacagaagggctgggtgcagtggctcatacctgtaatcccagcactttgggaggccgaggcaggtggatcatgaggtcaggagctcgagaccatcctggccaacacggtgaaaccccgtctctactaaaaatatgaaaatattagccagctgggcatggtggcacgtgcctgtagtcccagctactcaggaggctgaggcaggagaatcactcgaacctgggaggtggaggttgcagtgagccgagaccacaccattgcactctagcctgggcgatggagcaagactccgtctcaaaaaacaaaacaaaaaacaaacaaaaaaaccccaaaacacacacacacacacacacacacacacacacacacaaaccatagaagacaatataggcaatactattcattcaggacacaggcacgggcaaagacttcatgatgaaaacatcaaaagcaattgcaactaagcaaaaattgacaaatgggatttaattaactaaagagcttctgctcagcaaaagaaactatcatcagagtcaacagacaacctatagaatgggagaaaatttttgcaatctatccatctgacaaaagtccaatatccataatgtacaaggaatttaaacaaattcacaagaaaaaaacaaagaacctcgttaaaaagtcggcaaaggacacgaacagacacttctcaaaagaagacatttatccagccaacaaacataaaaaaagctcagcatcactgatcattggagaaatgctaatcaacacaatgagataccatctcacaccagtcagaatggcgattattaaaaagtcaaggaacaacagatgctggtgaggctgtggagaaacaggaacgcttttttacactgttggtggaaatgtaaattagttcaaccattgtggaagacagtgtggtgattcctcaaagacctagaggcagaaataccatttgacccagcaatcccattactgggtatatacccaaagaatataaatcattctattataaagatatatgcatgtgtatgttcattgcagcactattcacaatagcaaagacatggaatcaacacaaatgctcatctgtgatagactcgataaagaaaatgtggtacatatacatcatggaatgctatgcagccataaaaaggaaagagatcatgtcctttgctgggacatggatggagctggaagccattatcctcagcaaactaacacagggacagaaaaccaaacactgcacgttctcacttgtaagtgggagctgaacaatgagaaacacatggacacagggaggggcacaacacacattgggacgtgtcggggctgggaagggagagcatcaggaaagatagctaatgcatgccaggcttaacacctaggtgatgggttgatagatgcagcaaaccaacatggcacaggtttacctatgtaataaacctgcacatcctacacatatgtactggaacttaaaataatataaaataaaaaatataaaataaaacataccatgcacagttcctggcatacagatggtgaagctataagtaacggatcagaaatataatttaaagatgctgaagaggatattaaaatttgtaattataaatttaatttacatttttgtaggaagaatttttttaaagattttttttcttcttcatcttaattatatgcttttgactaatagaatgttagtaacaatacagattgacaggcaaaatgagaatgcagagtatttggaattttactatttcaaaaagatcaaatcaaagattagcttagtggagtgaatggttgatttgggaaatggttcagaactagttagcgaaaaagtctaagatgatgcattcttagatataagaaaggggaagagatttgaataaatcaacaaaacaaagatgaagcagtttcaatgagggtcgtgaacaaatttaaaaaagagaaaaagaaataaatgttaacatgaggtagttatagatcaattactttaagactaatacatacctctggaactgaagtttccatcagagacagtggaggaggaacacatccaccatcctgtgcaatttccactggttgataaataacctcagaaggttgcaggtataagaatggagcagaagaggcagaaggctaaaatacaaaaccatatttctaattcaaatatgattagttatttctgttaaaccaaatgacttagccaacagatgagagaagtacttgttttttattttactaaatttttttttaggaatagcacagaagtatctcagcaacggattagaaactgatctgttataaattccaactgtgtagatgtagttaaagaatcttatcattggtaagcactagaacttcttaatgactgagaacctcatatataaattcagataataattatggttatattaatgtcaccagtaaaggttgtgataatgtgatctatggtatttaaattgacataaatgtctactctcagctctgtgacttctaatgaaagtgggaaaatgtgaaacttttttggtgaagtactatttgttaccaaaagttgggaaatagaatacttatttaggaacagaataaaaactgaagccaaatccaaatgaagttagaaaaatgctaaattttcaaataacactaatagtaaaaaagggtaagttttcatgtttatacagtacacatttataaaatgctttcacttatgcattatcatttgatattcacaaaaatcatgtaaggaaacttacaaaggtatagtatcattatatccattttacaaatgaagaaactgaaaatgaactgccaaaagaataagttaataaacagaagaagaaggtctcaaatctaaaaaactttagtattcatgcagtcatcacaagaatataatgaaagaaggatttaaaattatatattgaaagttaacatttacctgaggaacactccactgccactgtcctggtaaatactgtgtggtggcctaaaattaaataaaagaaaagaaaaacccattctgattataaacaagggttaaaactagatatctacaggcaaaaatatgaagttggaccctcacaccatatacaaaaattaactcaagccatatacaaaaattaactcaaaatggaccagagacttaaatgtaagagctaaaattatacatctcttagaaaaaaacataggtgtaaatgcctgtgaccttgaattaggaaatgtttttaaaattatggttccaaaagcataaacaacaaagcaacaacaaaaaatagttaaattagatttcatcaaaactttaaaaaacttttgtgcaagtgaaaatacaacccacaggatgagagaaaacatggaacttatatcaagaatgtataaagaactcttacaactcaataatcaaaagacaagtaacccaacttaaaaattggtaaatgatatgaatagacttttctccaaagaagatatacatatggccaataaacacaagaaataatgctcgacaccactagccttcagggaaatacaaatcaaaaccataatacaacatcacttcatacctactaggatggctttaatcaaaaaagtagatcataaatgttgacgggcacgtggagaaattagaaccctcataatctgctggtgggaatgtaaaatggcgcagccctttgggaaaataaacacttccttaaaaggttaaacaaagttaccgtatgacccagcaattccactctagttataaaacctaagagaaataaaaatatgtgttcacataaaaatttgtatgtgaatgtccatcgcagtatcatttataacagtcaaaaagtagaaacaactcaagtgtccatcatctgatgaatggataaacagaatgtggtacagtgtatccatacaatgggatattatttgagaacgaagtactgagatatgtcatgtctcatttatcatgacatagataaatcttgaaatcattatgctaaatgaaagaagcctgtcacaaaagaccacatattgtatgattgtttttataggatatatccagaataggcaaatctagaaaaacaggtaagtagattactggttgcctagcactgggataaggggaaaaagaagactcaactcatctactgtagcacaaaaacagccatagacaataagtaaacaaatgtggctgtgttccaataatgttttatttacaaaaacaggctgctggctggagtttggtctgcaagccatagtttgatgaccctgctatagaccagaatgatctggcattatagttcacttatccccaatttctcactaaaattaatgaagagtgctggttaactgaaagaggatatcataatatataataaaccacaatatattatttgctttaatataaattatgttaaatataatatagcaagaaactgacatatgttaacattaaaaaaccagcttgcagtccaatacctgtatcttacttggggaattattgctaaagactttttagatctaaatgttagccaggggagcaaaactgacctcatcacatttggtaaaaggaagcaaagagtccatccatcttcttgtatgacattgtttaattccctcgtaaaaaaagagaggcatgatgtcagcaagatggctgaccagagatgcctagcattcattttccactggctccccaccccgccacaagaaaagactaaggcaaagaataaacagctacaatttgacaggagcatcaaaaggagagtgctggagtgccgcaggggagtggagacacacctgtggtgattgcaaatccaggagcgcagcatggagccacccagcctctgcaaacccttctcttctgctaggattggttctgcctggagtcctgcagtttcttattgcagggaaaaggtaagcagaagatccccaccagcctgcattgctactgcaaacagccacactccttgcaacaggagaatcccacagtctcacagtttgaagagctgctgggaattcgtggctgcattgccccgaattaggagtacaaagtgtgtactccccaccccctcaaccccaccctgtgagcgaagctgctacagcgtgacagcatcttgaagccatagtcatctctagggggccagtagctattgcacgtctccagtactggggttccattttcattctgccaagtacacaccagtggctgaacacaacctcagcagcatggaacctgaggctcaagattggctgtgattctggttctgtacagtagggaaaccaacgtctgttgccctcacctccagctagaggaacaatctggctgacctgcccagggtgaacccactctttagctggtcaaactgctgcactctcctgagcaggacaggtcctcaagcctcgtagtagctgacatgctgccgggatggaatggttacacacctgcatacagggctgagaaacagcccagaggtgcctcacgccctgcagacaagcccctgacctaccctgtgcatgcaattagagcccaagaaacagctccggggactgccactggcagaaatgtccccaggggagtggagtggctgtgtgtccatgcctcaggcctaagaaatggcctcgtgcccacccctccagcagacacgtccccaggacagctgagcagcctggagcctgtgtcccaggcctgaaaagcagccccataggctgcttccagtgggcatgatcccaggccgaccaatagccctgtgcctgcattctgggcctatgaaacagccctcacagaaacgtttccaggccgggtgatccaccctgtgcctatgtcccagacttgagaaatagctccgtgggccacccccagcagacatgcccctaggccaggtgagcagttgtgcacctgcatcctgagccggagaaacagcccctgacaaacatgtccctagccgactgaacagccatgcagctgtattccaggcctgagaaacagtcccatgggctgtccccagcagatgcacccccaggccagcgaaggagccatgtgcctgcataccagacctgagaaacagccccacaggctgcctctggtgggcactcctccaggctggctgagaaactgcatgcctgtgctctcagccagagtaacagccctgtggccccaagcccagtgagccagacttaccatgttcatgtacacagccctgacctgaggaacagctcagcaagcccacccctggcaaagccctaccaccattgtcatagactctcttttgctaggtcactgagaaacttggaaacacaactagagagtattacagcttaagagactaaacagagactaccctagcagataggttgaatctagcagattcaatctaaacagatcctctcagaggcacattatagtcaaattgttaaaagtcaaagagaaagaaagaattttaaaagcagcaagaaaaaagtatcaagtcacaattaaaggaatccccattatactaacagcagatttcttagcagaaatcttaccagggagaatgggatgatatatttagatatattcaaaatattgaaggaaaaaaacctgccagccaagaatattatacccagtaaagctatccttcagaaatgaaggagaaatacgatctttcacaaggccaggtgtggtggctcatacttgtaatcccagtgctttgggagactaaggcaggaagattgcctgagcccaggaatttgagaccagcctgggcaacatagcaagaccctatctcttaaaaaaaattagcaggcagggcacatgcctgtagtctcagctgtgtggcaggctaaggtgggagggattacttgagctcacgagtttgacactgcagtgagctatgatcatgtcactatactctgtctctaaaaaaaccagctctttcatagacaagcaaaaactgagagaatttatcaccactagattggccttacaaaaaaaatactcaagggagtctcacatcaggaagtgaaaggatggtaacaacgatcatgaaacatgcaaaactataaaattcactgggacagccattacacaaaggacaaaaagaagaaaagaatcaagccttataattacagagaacccagctgcaaaaaatcaccaaaaagagagggaacaatgaacaaaagatatgcaaaataaccagaaaatgataaataaaatgacaggatgtcctcacctatcaataataaccctgaatgcaaatgggttaaattctccatttaaaagatagagactagctgaatatattaaaaaaagagacccaactatatgctacctaaaagaaactcaccttacctgtaaagacacacataggctgaaagtgaagggatggaaagacatgtttcatgcaaatggaaaccaaagcaggcaagagtagctatacttatatcagacaaaaccaacttcaagttaaaagttttaaaaagagacaaagaaggacatttatataataatatagggatcaattccgcaagagaatataacaatgtaatacatatgtacccaacaaaaagcacccagatatataaagcaagtcttatttgatctaaagagagagggagaaaccccaataaaatagtggttggggacttcaacaccccactctcagcattggacagattatctagaaagaaaataaacaggccgggcacagtggctcacacctgtagtgccagcactttgggaggccgaggtgggcagatcacaaggtcaggagttcgagaccggcctgaccaatatggtgaaaccccgtctctactaaaaatacaaaaattggccaggcgtggtggcatgcaactgtaatcccagctaccgaggaggctgaggcaggagaattgcttgaacctgggaggcggaggttgcagtgagccgagatcatgccattgcactttagcctgggtgacagagcgagattccttctcaaaaagaaaaaaagaaaagaaacaaagaaacatggatttaaactgcaccataggccaaacagacctaacagccatttagagaacatttaactgaacagctgcagaatatactttcttttcatcaggatataaaacattctccagaattaccatatttcaggaaacaaaacaagtctcaaaaaattaaaaaaaactgaaattatataaagtatcttatctgaccacaatggaataaaacaagatatcaataacaagaaaaacattcaaaactatacaaattcatggaaattaagcaacatactgctgaatgaccagtgggtgaaggaagaaattaagaatgaaaatagaaacacagcataccaaaacctatgggacacaacagtagcagtattaagaggcaaatttataacaatgaatgcttacatcaaaaaactagaaatatttcaaataaacacccttacaatgtacctctaggaactagaagagcaagaacaagctaaacccaaaattagtagaagaaaagaaatagtaataatcagggcagaaataaacaatgttgagactacaaaacaatacaaaagattaacaaaacaaaaggttgactttttaaaaagataaaatcgacaaaccattagctagtctaagaaaaaaaagaaagtagacccaaataaataaaatcagcaatgaaaaagacaccacaatgaataccacagaaatacaaaggatcattagaggctaatatgaacaactctatgcaaataaattaggaaacctagaagaaacggataaattcctgaacatatacaatctgccaagactaaaccaagactgaagaaattgaaaaccttaagaaacaaggccgggcacggtggctgacgcctgtaatcccagcactttgggaggccgaggcgggcagatcacgaggtcaggagatcgagaccatcctggctaacagggtgaaaccccgtctctactaaaaatacaaaaaattagccgggtgtagtggcgggcgcctgtagtcccagctactcggaaggctgaggcaggagaatgacatgaacctgggaggcggagcttgcagcgagcagagattgcaccactgcacactccagcctgggcgacagagagtccgtcttaaaaaaaaaaaaaaaaaagaaagaaaaccttaagaaacaaatttaagtaacaagattgaatcagtaattaaaacgtcttccaacaaagaaaagtccagaactacatggctgaattctaccaaacctttagagaagaataccagatcttcccaaactattccaaaaaattgaagcagagggaattctccctaattcatcccattagtttgattatattaaactaaaaagttcctgcacagtgaataaaacaatcaacagagtgaacagacgacctgttgaatgggagaaaacatctgtaaactacttatctgacacagaattaatacccaaaatttacaaggaactgagacatctcaacagcaaaataaacaaaaaataaactgattaaaaatgggcaaatgatctgaatagacatttctcaaaagaagacaaagaaatggctaacaaatacatgaaaaaatgatcaacatcactaattatcaggaaactgtaaatcaaaaccacaatgaggtattatctaccccagttaggatgtttattgtcaaaaagagaaaataacaaaccctggtgaggatgtagagaaaagggaactcttatacactgttactaggaatgcaaactagtacaaccactatggaaaacagtatggagatccctgaagaaactacaaatagaactaccatatgatctggtaatcccactactgggaatttatttggagaaaaggaaatcattgtatcagagagacatctgcacccccatgtttattacagcattattcacaatagccaaaatatgaaatcaacctgggtgtccaacaacagatgaataaagaaaatatggtatatatatacacaatggaatactatttggctataaaaaagaataaaatcctatcactcatggcaacatggatggaactggaggtcattacgttaaatgaaataagccaggaacagaaagttaaacaacacatgttctcactcatatatggaagctaaaaaacactgatctcaaaaatctgccacctgcacagatatttttgaaagaaacaagttttatttttccccctttcttgtaataagtgataaaattccaagtctttttcactgccttccaaaccatgttcagaagagagtagcttatcctctgctggtctacactggttgctgaatttacttgtattcctgtttttgtatatgctgcatttagacttacatatggcaagaaggcatttttgttgttgttgttgttaaaggaaacaaactctcaaatcatgaagtgatgtaaatgttgcatatgcctacaaagctctgaattcaggtcccattgctgtcacaaagaaatgaatgtaactcctaccctaatcccttttttatataataaaactgccttagcatgagttgcaactgtcatcactacagtaagctggtttacagatgttttccactgagcatcacaataaagagtaccatgtgttacaaaaaaaaaaagttgatctcatagaagtaaaaagaatactaggggctgagaaggatagagggaaaggaggaatagggagaggtttgtgaaaggatacaaaattacagctacctcaggaatggaaaaccaaacatcctatgttctcactcataagtgggagctaagctatgagtatgcaaaggcataagaatgatacaatggactttggagacttagggagaaggagtaggaagagggtgagggataaaagactacaaattgtgttcactgtatactgctcgggtgatgggtgcatcaaaatctcacaaatcaccattaaagaacttactcatgtaaccaaataccatctgttccccacaaacctatggaaataaaaattaaaaaaaaaacaacaaaaaatccaaaacacctccaaaattacagctagataggaggaataagttctaatgttttataccactataggatgactatagttaacaataatacatagtttcaaatagctaggaggctattgaatgctcccaacacaaagaaatgataaatgtttgagatgatggatatgctaattactctgatttgatcaccatattacatgtatcaaaacatcactacataccccatgaataggtataattatcatttgtcaatgaaaaaaaattaaaaaaaaaacactaccaaggattaactatctcttttttattttttattttctaactaatcatttattttattttacttatttttaaaacttttattttaggttcaggggtacatgtgaaggtttgttacataggtaaactcgtgtcacaggaggttgttacacaaattatttcatagcccagtacccaatagttatcttttctgctcttctccctcttcccaccctccaccctcaagtagaccccagtgtctactgttcccttctttacgttcatgagttctcatcatttagctcacacttataagtaagaacatgtggttatttggttttctgttcctgtgtcagtttgctaaggataatggcctctggctccatccatgtccctgcaaaatatatgatctcattgttttttatggctgcataatattccttggtgtatatgtaccacattttctttatccatctgtcattgataggcattccatgtctttgctattgtgaatagtgctgcaatgaacattcgcatgcatgtgtctttatggtagaatgatttatattcctctggctatatacccagtaacgggtctaatggtagttctgcttttagttctttgaggaatctccatactgctttccacaatggttgaactaatttacactccaaccaacagtgtataagtgttcctattctctgtaacctcgccagcatctgctatttttgactttttaataatagccattctgactggtgtgagatggtatatcaatgtggttttgattcacatttctctaatgaactatctctttgtaattagcaaagtagttgcatgagaaagaaataaatgaaagttagctaagaaaggactgaaagtttcagagagaattttaattgtaatttatgtttacctggtagtgatatgcaggttgctgataaatgggctgagctaccatcacaggggagctacatacagaacgtgactataaaaggatggaaaaagaaaaattaggcagaagcctttaaaatagctcacaataaaatttatctcaaattattacctaaacccagtaaacttctggtttatgattagaaatattatttttctacctcttattgatatgattaccaactctactaagtctattaaaatcatcacaatatttctacttctacgtggtttcatttccatagtaatgctaaaacaatcaccagaaaagttgtttttagtctgaaatgtaccatctccaaagattatgaaaatatagttataagagaatacttagaggaaaatgacagcaagacttagggtgacgctgcctgtttccattgtggggaccagcaggaaacagttaatgtttataatagtgtttagaactgaatgaatagtcgtatctaattttcccactagttacaaataatcaatgttctattcctttgttatacctataattaaagcaaagatattttatttttattttagtaatttgacatttaaaagagttaatagtttgataaacttacaagtgaaaaatctgtgctgaaaaaagtacaggtaacacttgattattcaaagtgaaagagtaagccccaaaacagattacttaaaaccagatctttaataaaacaggcaagttgtattgcaagatagtaaaactggctctaatgtagcaattaaaattcagtgtctaatgtgggatctaacttatattgttttgtttaatgtttgcacccccgaaactgaggaaaagtatcacagttttgtacaattcacagactatggtatgctaataaaactgtatcactgattaacattagaaaataataatgtaatttcccatattaatagattaaaggagaaaaaatggtaatttcaacagagacagaaaatgcatttgttaaaattccatacctttttatgattaaaaactcttaacaaacatggtagaaaatggcttccttaattgatttagggcagtaactctcaaccatgagtgattttgtcctatagggaacatctggcaatgttgggagacatttttgattatcataactatggggagcctagggatacttctaaacatcctacagtgcacaggacagaccttcacagcaaagaaataatctggctcaaaatgtcaacagtgctaagattgagaaagtctggttaagagtatcttcccacttacaaagtatgcgtgtgtgtgtctatatatgtatgtatacatgcatgcatacatgtaaagtttaatggtgaatcactgaaattgctccctttttcaagaacaaggtcatgatgttttcactacatcaatactgtagcagagacatggtcagtgcaaaaactccaggaaaaaaagaagtgaaagaaatagaagtacactgaatcataaataattgtgtaaatgagagtttggcagggttactgatagattatcactattgaaaaatcaagagcattactatacaccagctacaatctattaggaaatgttatttaaaaaacagcattcattaaagcaacaaaactatagtctactaagaataaatttgacaaaatgtgtcacgcttttttatggagaaagaaaacttttttatggatagaagtaaaataagacaaataaatggagagatgtatcatgttcatggataggaagattcaatattttaaaatactgaaatgtcccaagttattcacactatttaatgcaattctaataaaaaaaagggcttttcactgaactaaacaaactgaattaaaaaatttatacacataaaagcaaagacataaggatagatgagagactcctgaagatgaacaatgtactttaagatttcaagactcgttataaagtcaaaataattacaactgggcaaggtgaacaaatacaccaatggaacaaaatagcagaaaaaagacccacacacatggaaacttagtgtttggcagaggattaatttcaaaatagcaggaaataggtggattagtcgatacataaattcaagatttaagatctagaagtgaaaagtggcaatactatagcattaaaaataaaaaatagcatatattcttgtagtaaaaaacaaaaaactaaaaaagaagaaaaaatcttgtgccagttttcaaagggaatacttccagtttttgcccatctagtatgatactgactgtgggtttatcataaatagctcttattattttgagatacgttccatcaatacctagtttattgagagtttttagcatgaagggctgttgaattttgtcgaaggcctttcctgcatctattgagattaatcatgtggtttttgtcgttgggtctgtttatgtgatggattatgtttattgattcgtgatgttgaaccagccttgcatcccagggatgaagccaacttgattatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattctctctttatctattgattgaaatagcttcagaaggaatggtaccagctcctctttgtacctctggtaaaattcggctgtgaatctgtctggtcctggaatttttttatttggtagtctattaatgattgcctcaatttcagagcctgttattggcctattcagagattcaacttcttcctggtttagtcttgggagggtgtatgtgtccaggaatttatccatttcttctagattttctagtttattggcgtagagccctctctcttcactcctattcaacacagtgttgaaagttctggccagggcaatcaggcaggagaaagaaataaagggtattcaattaggaaaagaggaagtcaaattgtccctctttgcagatgacatgattgtatatttagaaaaccccatcatctcagcccaaaatctccttaagctgataagcaacttcagcaaagtctcaggatacaaaatcgatgtgcaaaaatcacaagcattcctatacacaataacagacaaacagagagccaaaccatgggtgaacgcccattcacaattgcttcaaagagaataaaatacctaggaatccaacttacaagggatgtgaaggacctcttcaaggagaactacaaaccactgctcaacgaaataaaagaggacacaaacaaatgggagaacattccgtgctcatggataggaagaatcaatattgtgaaaatggccatactgcccaaggtaatttatagattcaatgccatccccatcaagctaccaatgactttcttcacagaattggaagaaactactttaaagttcatatggaaccaaaaaagagcccacattgccaagacaatcttaagcaaaaagaacaaagctggaggcatcacgctagctgacttcaaactatactacaaggctacagtaaccaaaacagcatagtactggtaccaaaacagagatatagaccaacagaacagaggcctcagaaataacactacacatctacaaccatctgatatttgacaaacctgacaaaaacaagaaatggggaaaggattccctatttaataaatggtgctaggaaaactggctagccatatgtagaaagctgaaactggatcccttccttacaccttatacaaaaattaattcaagatagattaaagacttcaaatgttagacccaaaaccataaaaaccctaggagaaaacctaggcaataccattcaggatataggcatgggcaaggacttcatgtctaaaacaccaaaagccatggccacaaatccaaaattgacaaatgggatctaattaaactaaagagcttctgcacagcaaaagaaactgccatcagagtgaacaggcaacctacagaatgggagaaaatttttgcaatctacccatctgacaaagggctaatatccagaatctactaagaacttaaacaaacttacaagaaaaaaatcaaacaaccccatcaaaaagtgggtgaaggatattaacagacacttcttaaaagaagacatttatgcagccaaaagacacatgaaaaaatgctcatcatcactggccatcagagaaatgcaaatcaaaaccacagtgagataccatctcacatcagttagaatggcgatcattaaaaagtcaggaaacaacaggtgctggaggggatatggagaaataggagcacttttacactgttggtgggagtgtaaactagttcaaccattgtggaagtcagtgtggcgatttctcaaggatctagaactagaaataccatttgacccagccatcccattactgggtatatacccataggattataaatcatgctgctataaagaaacatgtaaacgtatgtttactgcggcactattcacaatagcaaagacttggaaccaacccaaatgcccatcaatgatagagtggattaagaaaatgtggcacatatacacaatggaatactatgcagccataaaaaggatgagttcgtgtgctttgcagggatatggatgaagctggaaaccatcattctgagcaagctattgcaaggacagaaaaccaaacaccatatggtctcactcataggtgggaattgaacaatgagaacacttggacagaggatggggaccatcacacaccagggcctgttgtggggtggggggaggggggagggatagcattaggagatgtacctaatgtaaatgacgagttaacaggtacagcacaccaacatggcacatgtatacatatgtaacaaacctgcacgttgtgcacatgtaccctagaacttaaagtatataaaaaaaagaaatgcaaaaaataaaaaataaaaaccactaaagcagtactatatgtcatttatgaatacatatatttgtagtaaaaatatataaaatgaataggaaagatattctgcttacttttgaacaggaaagagggtaaggaagtgggggtaaggagaattgacctgaagctgtcttactttactccccattttaagaacttaagtaaatgtggcaaaatgttgatgtctatttaatttggttgatgtgtgttattatttgtaattatctgtggttaagatatttcagaaatataacaaacattaaaaaattgatagtaatagatggaaatccttttttaaatgaaattacttacaggccaaggcggtgggaccgaagttacctctggagtatgaaaataagcaacaccattatggtaagtataaggatatccagttgaagttgttagatacattgttccagctgctggcattatactagaacctaaagcaaagattaaataataataattgaaatgttcaatttaactgttaaaaatgtagtttctaaacacttcagaaaaatatttatcttaatatacctatgtagctatggtaaaaattgaatgtcacagatatttttaaaaaattccttatgtcaaagtatctttgaagcctgtatttttaaactcaataccttaaagcttttagtttaagatgattaaaagaaaagaaaaacaatacgaataagaaataccaaaaatgtatcaattcagattccaacaccagtatgctacacaaagctgaacaatttagactatcatcagcgaagtaattatttgtacaaatataaattatgtataatttaaagttacttcaagacaacatacactgtagtgaagttcctaaggtcttggctagaccttttatttctgaaagtccaaagatgatggaggcagtaaagttggagaagattctactttcctgaagacattttggttccaccctactaattctttggatatcctaccagcaaacattcgttcatgctatggctgtcttttatctctcttttctatgatctattctctatctagtctccctttgctacaactgctgctgttgcaaacatgaccgcaagtcttcatgtggctagtctggggtccccaactcttttcccgggccaagttatataaacccccaccacaaaccaaaaaacagtaaataatatacatagatatatatatattttttgtcattgaggagactttaaaagttaaattagccaaattagattaggtcttaaccagcaaggttatataaattagtgaaactgacaattcttccacctataccagtgcttctcaaaatttcccataaattagaatcacttaaattgttttctaaaatgcaaattccagggacttatcttcagagattttgagtcagtaaatctgggacagggcctaagaatttgcattttgacagcttccaatgaaatgacactgtctgcaaaccacacttcaaatagcatgggcctaccactttaaataatactattgctcctcagcttttatattttcactgcatttgatctagtattgttattatttattttaatggttcttaattagatccttttgagaatttgatgaaaatcagggaccttttcctcagatatatatacagtcaaacacaattttacacacaattttggaggtccatggattccccccaaaagatattccactattattcaaagataatgataatggttcattattcaataatggttcattattcaaagaaaatgaaccatgctttacctgctaaataaataaattttcagtgcatactatttcaaggcattgaacagggccctagtgatacagcaaaaaataaaaaaattagacatgagatggtctgtatcctcaaagaagttaggtctggtagtgaagatagtcattagttgattacacaattaattaattaaatacaattttgataaatacatgaggcattatagggtacgatactgaacatttcaattattatgtatacaaaacatatataaaatttctctctatatacatatatatggaaaatttgtgatgaaatgatgttcagctaagctctaaagaatgaattggatggcaaagtacattctaggtaaagaaaacagtatattagattctgagaacaggagtatagaatgttctggaactgaaagaaggctacatggctaaagcatggaaagaaaagggaagaatacctcaaaataagctgagcataagacaataagaggtgcacttttgaaagatcactctggctgccttgtgaatgatggattggaaggtagaaagattggattcagagagaccacttaggatgtttttccaggaattaaggtaaacaaagtggttagttgggactcgggtgttggtaatggagatggaaagaaatgacagatctaagaaaaaactaagataagaatcccttatttgtaaatgtacttttaacacctatttttcttcgcagaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacatttttaaaacaatgactttatctttttgggattgaattttctatttacaaaaatagagataacaatacatcatgggattctatgaagattaaatgaaaactcataacattgacccttgcactaagtagttttgaaaaaactatttgtatatgtgaaagcattcagcatagtgctgatttattttctatttcagcaactggtagatcatactatgagcattactatttagtacatattgctggtgataatgggctaacggaccgttactatatgttctagcttaacctttgcaagtaacaacagtagattgaaaatattcagcattctgccatatttagtgcattccattttgtattaacctactgaggatactttgattgtctcctaaattaacaaatactaagtcaaaattaaacttaatatacatcaatctcttttttgttgtagttgtggcaactgtattaaccaaatatctattatttctaagtcaaaagcataacagtccaaatgaatacaatctattaatttgttaacagattatatataataacctaatgttttaaacattcccgtagacactaggatgtggctaagggaaaataagttagttataaattttacatcacatttctccttctagccaaagactgttaggaattttaataaatattaaaggtaaaaagttaactataaagatgcctaacttaataagtagaaagagtgaggaaagatagaattgaaagcattagagaaatttgaggaaggtagatacataatttagccaattcctaaagctttagggattgtccccctgaaaattatgacacacctggctgggttacagtacacagcatgcagcgagtttctgatattagttctatgttttcactttcaatatttttactctgattaattttaaattagtttctaattaaaatttttctcattagtaagtctaaattattaaattacttctaattacttttgctatattaaatgatattttcatcacgaaagattttttttcctttaatgatgtaactacatggaatatacttaagcatctttatgtatataaattttttcccagccaaaaaaattgagatatattattttgtggcaaaaatattcagtttttccaccaactttgctaaaataactttattagatgaaagaaacatgatcttttaataaagttctataaaaagtcttatatttcaaaaaagaaccatgcaaaaatatttaaaaatacattagttctcaatacatacgagggatccctacttgttgttttcttattgctggaccaatgttcagcttcttatccttataattaagtttttcagcctaaaataaagaaaaaagaaattattttattattttagcactattatttataaaatcaataaggaaaaactagttagaaagaatttcaaaaattcagactataatattctttcaaagcagcaaggaatagtgggaaagagccgtcttcagactgaaatagatctgggtctgaccgcaattccccattttctccatttgtaatacagtcaatcctcattactcatggattctgtatttgtgaatttgcctacttgctaaaatttacttgtaatcctaaaattaatatttgtggcaattttgaggttattagtggacacgtgaagagcggcggaaaatttgagtagcctgatgcgcatgctcccagttgaggtcaaataaggcgatattctttcttcttgttccagtgctcatactctaagagagagctttctatttagtgccatgttttctccatttttgtgctttttgttggtgatttggctatttaaaatggcccccatgtgtattgttgaagtgctggctagcacaagaagactgtcataggcattatggagaatatatatattagatgtgcttaattcaagcatgaattatagtgctattggccatggcttcaatgttaatgaaccagtaatctgttatatatgatgcctttaaatggaaaaccatataaaacaaggttatatattgataggttgatggcaatattgtgaccagaggttcttgggaacattaccttgtacttcccctagaaagaggagttcagcatttgctaattcagtgttcctagcaatgttagagaacataactgccacaaataacaagaattgactgtatttgattttaataacatacaattcaaattctactttttttctaaaaaagttaaatgttatatttgccttaacttaaagttattacactgaattgctggctataggctttttttctgtgaatattcttagtttatataatgtttttcacaggagggaaatcatctcagataacctcactgttggaatccacatttgtagtgttttttaaacattcaaaatgctattaacacttcgcaaaagatatatccccaagttcttaatttaagtaaataaagcgaaacattatattacagtttcacaaccatacttgtagtgattttggaatttgctcttctgcagattaagtttcctagagaccaatgccaatcttaagatgcaaaccttttttaaaaagcagttgattattgtatttgaaccccgaaaagattagtttcaaatacaaaatttccagaaatgaagttaaatacaccaaaagatcatacctcttgtaaaattttttgtgcatcttcttgtgtttcaaaagtgacgaaaccatacctaaataaatgcattaattattactaattaatcattttcttagaatgttatattaattatattaaaatgtttaaaaattttgtttttaaatcatcggccactgtaggagtaggcatgtttctatgctgcactagcatgggaatcttagaagaatcattcacagcctaacactgtcacttttagtcaggaactaaaagaaaaaaaacccctgagatcttgaaacagcttcagctctcagctgtatgcaggaaagaaaagcacaagagattcatgctgttgcttaaaaattggggatgcaataaatttcaatccagagcaataatctccttttaaactaatagaagtttggctaagagaaatcaaagtagaaaaataactaaaaaatttaaaatttcaacacaataaaatttcttatattggtgaatgacaatgtaaatgtattatttaattattattattagcacatataactgataatgtaattattagtatattcccaaacaatatcaattaaaaatatgtacaacccagatttcacatctgtttttcatacataattaacttcaagcacaattcatataatgttgaagatacaaatacacataaatgatgtgctccatgtccaaaaagccacaataggtagagaaaaaagtaacaaaagaaagaaaaaatgtatctctcaaaacataattgctatttagataacttaagtaaactcttctgagtaatgctaaatatcttcactattttcttcaattcataattactggatcatatacaaagtttcttcttttaaacaaaggaatttctctttatctatttgcccaaacattaaaaagttaaggaattagttttacgctatttttttggtagaacacacacgccacccagtggaaaaggcataaaatacagtttacatttacatttccatgtatgttttccaatgattaaaaaatggtattaccaaaacatagcaaattctgttagtcaaacaaaagaggtaaatctcacttcaccttaatattgtttggcattctgaggaagtatctcatctgtttataaataacctttctgtagaatcccatctcttccagcatatccatctgtcgaatgttgtttctcaccaataccacctcaatgggtcccttttcttatgcctataaatatgtatgtctcgtctctctttcaagaaagtaaatacaatactttactgccttatctattttcttttaactttgcagtccaactccttaagtgagtgtactatgtaaactatctttttcctttctgaaatttggctttgtacacatagcattccactgaaacagctctatacacatttaaagacacagtctattactttcttctcaattttcattatcattgatatagcaattaaaaatcattctcactagaattatatttctcatactggtcccctaattaggtctctgaggcacaacctacagacatttcttggtgtcagctgttttcaaataaagctctctatggcctaaagcagggatacaattccaaaagaatctgattccttttgcttctcattcctcagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatctatagtgatactaaccctttggatactccagctctgtcatttacaatcttcacttctttcacagacccatactgggaaaaaaattttcttaaatcactttcgtttgtctaatggcataaaaagaaaacgttaaaaagcatttttagttgataaaagatgaataattctcatgcttgctctggagacagaaaaagttatagataagatgcatgaaaaatgcctctcatcatcaaaacagtgcataaaccactaggtgattaaaatcaaggtaaatatcttgctttatgcaatagctatgttgttaaattaccatatgccaataaaaatgtaagctgaattattttaaaactacaaaactcactatttaaagaaatctttaaatgattcttgttctctagctggccagtttttaaaaagccaatttggattaggaatgctatttccatagtaagggtacaatactattttggctcttgtggctcagagacagtcatggcagtggaactaggttgtgttggcctacaccagtcattctattttaatcagtagtctcaggaactcctttcctaagtcagttttaggaaaggaatgtatttccaaaagtgcttgaactcaactgtgagaacaatggagtgactataagatttaaagttattagattccttatctgtactcaatatacatttcagctaaattcagacattgttttgataataaaataaaaattggaatcataattagatttaaagcatacaaggtgtctacaaagatggttttggcatgtctgtttttttaattgaaatagtctgataatagactcatatcaccttttctcagaatactgacactaaattcattgcaatttcatttcctggtttagctgtaactgtttgtctacaagagtaacttttctctagaaaaaaatttctttatatacactgcaaaaagacatgccttagtgcagagctatgccttttgagttcaactgccacctcactacttacatacactattggtttttagttggtaacataaagcctgctaagctgcataatgacaaatactgattcaatctaagaaaaactgaatgacttttatttcagttaacagaaaatgaaatcaatgctagaataagaattgttactagatatttgaatacaaattaattccaactattctctggtagaataatcactacctcaattttgtagctccacttctttagtgacaaagagacagtcaagaaaagtaagcattaagagggatagtctgtttgcttataaaaatgaaaggttaaaaagtctgtgactacttgctattaaagtaaatgatttccttgctggcctttatctgtggttttgaaaaaggtataagtatacaggaggaagccctagcaattaccttaaagctatggctgcattataacaaccgtctccaaagtgcatgctgtagctgatgggcttcagtaacctaaaataacctggccatacaaatgtttatatttattgataacttatttttaaaaacatgctaatctattgtaatataaatgaattcccaaattgaacatttctgccagctatcagtattttccacaaagaaaatctttttaaaaataaatattttataagaaataatttttcttactttatttttagtgaaacaatcatatacttgtttaagactcattgttttggcaaatacactaagtgtaacatttctcttgtgcaggaaaaaagaaattccacccaaattgtaacagattggttatatggaaatagttataaatgtcaaatatcacacctaatggcataaggaaggttttttttttgttgaaaatgataactctccctataatttctaatatgtaaaatagaagcttggaaatccttctatatatccatttgaaagtaagagtattccacttaaaatatctatgcatgcctttcttgtaggtgtttactcttacctcccctatgtgggctggggggcactgcacatcatgtcatgaactatgctttcttgaaacagtggaatggctgattacatgatataaatatattagtttttaaaaaacttttattttaagttcggggtacacgtgcagatttgttataaactcatcattggggtttgttgtatagattattttggcacccaggtactaagcctagtaccgaatagttatttttttttctgcttaaatatactacttttaagatgctttattctgacaaggacacaggacttttttggtgatcaaatcctaaattctaacatagaaagtgctttgcaaagaatagatgcctaggaggttgctcaggaatctgagataagagttggggtaaagaaatagtatttcataaaagtaagtttttaaaaaatagagtctcttttgaaaattataataatcaattattttggctattggaatattaggcaagaaagtataattagttctggtatggaagagtatggagctatgagacagaaaactaggcttctagtctcactctgtcactatgtggctagcagcccacagcaagtcagtgaggatcaatttctttatatctgacattgaacagtttttaatgctttatgtaacctacatgctggttgaaaagattctttataataagataattcaaaatctgttaatcattatgcaaatatgttattttatagttgcacaaagaaataatttctgagaaataaagacttctaatgaaaaaatacactttactgcatgcataaataggtaccttaaaatcaattcctcctacaaagatgcgattagggatcactgttccatatcttggggcacttgttgggttattcaaaggcacaggtgacacaggattaggggatggagataatgaatctgtttgcatctggtttgatgtttgctgtaaaataaaattcttttacactttttgcactgggtataatgcagtctgcttttgatgcagaccaaaaacatatatttttcaaaaagaagagtcatttaggcaaaatatagtattctaggctttacttttaatattataaaaattataattagagctaagagctttttaaggcaacagaactaggaaacacagaatctactccactatagagattttaaatattaaatatattacttaaaatgcttatattattatcaaacctattacttaattattaaggggaatattaaactcatgaacatgtttgagaaagagaaaacagtcccagcctgacacaatcaactacaccctggtgttgttaggagttggcctggcactcacagctaggctgtggtgttctcttgttaacagaacaccaacatcagacaaagtcaccctgtgactctgatggatcaagattaaaaacaagaccactccataatcatgtttgaatgctgacaaaaacaaaggcattgcccaaaccacaagaataaccaaacaaccctccattctggctgatatgagtgactgctccttctttatcagctatagttttagcctcgatccatttttctttccttttagataaaagttaacacatccaatcatagaattactaccatttcctgacgctatacattccagagtaaagccctacttccttaaaccctctctagaaattgctcaacagaagcctatatcctgtaagttctaacaccttctgattgagaggccccatggtttatgttttcccttgtttgaacaattaacagacccaactttactaaatgacgcatgtgttcctggtggtctttaactaatggtcatcgacaagttaataaactctaacattcacattcaccattttcagcctgaaagtcaaaattttaaatgcacttgtcaatttgaagattggactgattttgttaaaaaattatatacttgtagctcataaatgtttattccaaagaattagctcagtacatatccacatgttcacaattctaagttagaggacataatttaaattttaataaatatatataaatgtataagcctttgcagaatggtaagataatagacttttaaggtataactgaaaaaaaacccaagacttgagaatcacattgaagagaaaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgattggctgctggcggcgggacggggcggggcgggatggcacgttgccgctgcgcctcgggcctgtgcgggcagtcctccttcacttccccaagtccaccctgactggcttgggtgcacagccagggctagagtgtccgggtcccgcctgggccacaggcgggccctgccaggtctctcagaccttccggtcctcgctgaccagtcggggagtggaggcgtcgaccgccctggcaactcctcgccttgggcggctgggtcgagttcggccgcagggagcgtcaaagacgctgcctagcccaatttcggcgggaaagcggtttacctgctcggacttcgctgggtgcctggcagcccgccgcctcccgaaacatccacgcctgaggtcccctggcccgtctacacccagtccaggccccgtggcggcgcctttctgacccccatgacacagccagacgaggtctgcgggcgggtggctcctggcagcggtcgatggggcacctggccacgtttcttcccaaccagatagcgagcgtttggggccttcacctcgcccctccaagccctcagggacaggctccacgctgctccttctccccgctatcccgcgccctggggccctgatcgccgtactcaccggcccggactcggtttccatcttcctctctgctcttcagagacgcggggtagggaaaagaagcctaaagtttgaaaccaccttcacgccaaggcagcagcgctgcttgtcctgcctgggactctcgccccctggcggcgagggtggctgtggcagctgcagggaagcaggctcggaccccggccctgaacctgccacctggcgggtggggagaagcggactgcgtcgcctc

SEQ ID NO: 991 - DNA, 50061 bp, Homo sapiens
cgcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatcttttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgtattttgttctaagatgcatgttgacactaaagtgtgtgacttggtgattttgatccctttgtctgaagaaattgttttaatgattttcgtggtcatttaaggcatagctgtgtcaggcagtgaacatatctacccagtggtggcacaggttaagtgttagtgagtggaggaaaacagattggttgaaaatggactgggaaagattagtgttgtgccttttgatgctttccccagcccagctccctaatggtagagtgatttcactgacagaagttcagtgtaatgagttgaggtagcatttgatgtggcattttggttggtagggaggcagatgtgtattgggaggggaactcacaggtgtttctgataggctctggtaagggtaagtgcccctactaaaacagcatcctacaaagtagattggagtaaaatgagattctcaacaaggagcccaggttgaaaagaccatattttggtataaggtaatcagaacctggtagtggaagtgggaataaaataaaaagattattcccagaggcacttcaagaaccaaaaaggggccgggcgcggtggctcacgcctgtaatcccagcactttgggaggccgaggcaggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggtgtgaacccaggaggcggaggctgcagtgagccaagatagcaccactgcactccagcctgggtgacagagcaagactcaattaaaaaaaaaaaaaaaaggattttgtttagattcaatgtggaggatgaaatttaaaatagttaaaataatttaaaattaagaaattgaagataattaaactttctattctgggaaaaagctggagaaatggagtctgagaaagaagctggaaaaatggagtacaaagttcatttataatacaaataataactaatttttcagtgctatgaatttgtttcgagctaaatgatgtttggagcttcctaaatccttattttcagaaacagggccctaaacgttttagtagagaggaattgcttcctcttttcctgtattcttgagactaccagtcagttctgtcagtgacgatgagataagcgtacatgggggaggggctgtttcctctggggagagaatattgactataaacaccctttatggctcatagagaatgaatcagaagtaccatacagacaacttttagctttcctccccctgtatctagaattatccacaagctctggattcttattcagattacttgcgatcaatcctgggtactccgtcctagaaattgcttttgttttatgccaaggagaaaatgactagtgcctcagaatttagcattgagaacacgtctgatcatcttatcttcctgtagtccaaattaacaaacttttaataatcacttggtatgtgtcaggcactatggcagacctagtgaatattactatagctaatgtgcggttagctatactgcacattaactggacacagtttcgagtttagtagcaagattgattagaaaggaagtaaagtggaagctgatgggatgagagatagtcaatagtgatagagactggatgagacatattgaaagggcctggcactagaagatacgtcacatatcctgctcctctttccttacttagatactcagtgttcttcatgtaagtgactacacatagtatgcactctgtaaatgtttgctgaatgaaagaataagtgaatgaatgaggactgattagactaccccaagacaacctaaagttctccaaaggaaacaaatatgtactttacccattatagtgtggaaatctaaaatgagaatttcagaagtataagaattaattaaaagattgtgaagtcgagcatggtggctcacgcctgtaatcccagcactttcggaggccaaggcaggtaggttgcttgtgcccaggagttttgagaccagcctgggcaacatggcaaaaccctgtctctactaaacacacacacacacacacacacacacacacacacatacacacacgaaaaagattgccaaggcccagtctagtatttagtccccaacagttttcctagggatgtgctttgagaaaccatatttgttcttaatgatggcagttgcaactgtttaggactatatcctacaaaaaatcctgcttccctttaactatttaaaggatttttaccatgatattagcccttttatattatttcttagaatgaccaaattcttacatttattacttgttattcaaagtatattacctacttaatctgttttttattaaattgcttttagttactaaagtatgagtgtgggtgtgtgtatatgtgtgtgattaccatggtgaagtttaagggaagagacttgaaggatgtgttgatctgcacatatggatatatacatatatatatatatatatatggatctctattatttgtatacactttgacttagtgaataatagatgactgtgtaggtgaataaagggaaaatagtacgtttccacctggatcccgataatctcacaggcatgatgtagtctacacaagtttggaaaataatgaccatgaggtcagtgggtatattgcaaaattgtattattttccctgcttgctcctctgttaggattctcctagttttagactgagtttgaggcctgtctcagcttaagaaaaatcactctgttgggtgatgcatagatttggcagtgtcttaacccttgctgaactgagggaaaaacagtgaaactgaactgtacttaaattcttctcttttcatatgtgtgaaaatggtcattggctctttgatctttcatcttcctctagaaagaatatatatcaatttgtgtattttgcatgaccagggtgaggggaatcacataggattatgaagcagttaaatggccttaagaaaaggatcatgcgattctggagtgagagaggagggtgatggctctaagtggtgaatctgaggaaagtataaagagggctccaaagcaggaacagtacagaggtcctgacagagagccatgaaatgtctttagccatgaaatgtgcttgaaccccaagctcaaagagaaaaggattttcctgcttgctctagggaagttcaaccttggataaatgggggaaaatgtaaggctaaactcaagatctggactggccacgagggagaggcttgctcattagagtgattggaaggaagtgagagggtctgaaagacaatcttaaaggaaggttaataagaagaacatataaatatgatgtttgcctgaaatgtaagcatgtgttttgaacctctaagattccctcccaactacagctgtgctttgtaattttgtgtgtgatgtaggtcatgaaagagtgagagtgggatgctgtggtacatcagtagagaagaagaaataaatgcctttactcctctagagagggtctgtgaaggaacagcctgccctggtcatctaggtagaattgcagaaagtaacccagggcagcaggggcagaaaccaaccaggaagtctactttagcctcgctctgcaactcctgctttccccactcccctcccccacgttgtcctagctacaaaataattctgaaaagttaactgtattactttgatattcttaataaaaatctcataggtggaatatagtgttcagtctctctctcctgctttgattagtttaaaattattaggccttggagaagcccttatgagtttcactttctatttcgtctttaaaagatgattttgcttttgatactattatggcttttatcttctgatgtgtgactatttttgcccctactgtatcctcatgaaaggtttatttataatatgaaagaaaatatccatttctgaattccaaaaggtgtaatttgaaagaaatgttgagcagttaattgattcattttaactttttagaaaagtcaaaagtcctcatacagattccctgtgcctaaaagatgcatgatgttctgtaagaaaataagttgcaatagcgagttctaatgctaccttttaatctcttttacaatattatgaataaataaaacatttctctctcttttttaaagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggaggtaagtagtaaaacttcaatcttatatttattgtagttacgagtcaagaaatagaacctaatattaaaaaatggattttttaaaaaactgttgaaaattagggtttgtacaaccaaatactttatcctaaaggattcttgaatatatagaacaatagaaataaaatatcataaaaatggaatcagaaacagtagtgtaagaaataaaagggggcggccggctgcggctgggtgcagtggctcacacctataatcccagcactttgggagaccgaggcaggtagatcatgcggtcaagagattgagaccagcctggccaatgtggtgaaaccccgtctctactaaaaatacaaaaattagcttggcatggtggtgcgcacctgtagttccagctacttgggaggctgagacaggagaattgcttgaacccaggaggcagaggtcacagtgagctgagatcgcaccactgcactccagcctggcaacagagggagactccatctcaaaaaaaaaaaaaaaaaaagaaaggatcatttgagctcaggaattcaagaacagcctgggcaacatggcaaaaccctgtctctgtaaaaaatacaaaaatttgccatgcatggaggtgtacgcctgtagttccagctactcaggaggctgaagtgggaggatcacctgagcctgagaggtcaaggctatggtgaaccatattgtgccactgtactctagcatgggtgatggagtgagaccctgtctcaaaaaaaaaaagaaagaaggaaataaaagggtattgaatatggttaccagtattattactagaaaaagaaaggtaacaagttaaatctaataattataaagagaaaaaataattataaaaagaaaaaatcgaactttaaaaaaataaaaattttgtatttcatgaataaaaatttcaagagtcctacagtttaagatatgaagtccaattataaaagaattgatttttttaaggggaaatagtggaattaagaatgtcattaggaaaagtaatctagaaataatggaaatagaaattattttaatccctttaaacatgagcaatcaataaaatctttgggaaaaaatgtagtttatactctttatccgagtgattttatttttagtgattatttcttaggaagtaatcagaaatataattttatgcatgaagatgttaattggcatcctgtttataataaagaatggttaaataagttgaataaattagaatgtgtggcagatagttacctggaattagccaaactcaagattaagagcatagccttccacactgccaagtctgctcaagacttttgataccaattgcaaaggagtttggcaaactgcacagagagaacagttcccacaagattaccctcacatcatcccagccggctacaaatgtgggggttgcccatgacactcaggtttggtaatttgctggaatgtagaaatgactcacaaaactgaggagagtgctatacttataattacagttttattgtagcaaaaagatagaaattagaaccagccagaggaagagacacaaagcgtggaatgtgggagggttccaatcttgaagcttctttgtcctgagggacacattactctctcagcattgatgtatgacagtatgcatgaagtattgccagtcagggaagctcacccaagcctttggtgtccagggtttttactgaggctggatcatttattgcctgtattgctgacctttagtccccagctccttccagaagtttggggtaattcctttagtctccattaagcccccatcctaaatcatgctgtgagactctccagtggccaaagcccccagaggaacaaagacagaagtcttgttctttcagataggacattttaggggccagagatcactgtccagtagccaagggcaaagcctgacttctctttgggtaaagttaattttttaccacacaatagttaagtggtaatgaaaagagatatttaccaaaattttaatcttcttggaacaccttatatatgatgttatgtgagaagaatcaggattaaaaatatatatgtagtatgatcttaacatatacagtgtaatatgcaaacagcattatgtatctatgacattatttcatccatagaaaaaagactgaaagaaaatacgccaaaatattaattcattatctccaggtaatggaattatgtatacttcccaaattttcaacaatcaacatacattatcatttaaaagcaacagttttttttttctactatgattatttctctctcttttttgaaatgactgccagagagtaatttaaaatattttataaaagtgttttggagatatgtagaaaaaaattagaaaagaaacaaaggataaaaagttggagatgaatagtagattttaagactcattcagattttcagattctgaaattgtcatgcatcttataatcattgtgtatatataatttgatggtatttctttttccccgtaatgctgttattaaattgatgaagcattataatcaatggtacattaaaattaaggtttaaaacaaatcagcatctcagatgcaaatgagcagactggagctttgctgcaagagggaccactcagctgttctgctacccatttatttttaaggataggactccattccttgaagtaacagtagtcatcataagaaaaatttcattttaagaggttagaagagctgttgtcctaaatgtactgttatacataagaaattcagcactggtgtggtgactcacgcctgtaatcccagcactttgggaggccgaggtgggcggatcacgaggtcaggagatcgagaccatcctggctaacatggtgaaaccccgtctctactaaaaatacaaaaaaattagccgggtgtggtggcactcgtctgtagtcccatctattcaggaggctgaggcaggagaatggagagtggcgtgaaccctgggaggcagagcttccagtgagccgagatcgcgccactgcgctccagcctgggtgacaaagcgagactttgtctcaaaaaaaaaaaaaagaaggaaagaaagaaattcaagtgactgggtgtggtagctcatgcttgcaatcccagcactttgggaggttgaggcaggcagattgcttgagcccagaaattcgagactagcctgggcaacatagtgagaccccgtctctacaaaataatagaaaaattagccaggcatggtggagcatgcccgtaatcccagctacttgggagctgaggcaggagaatcacttgaaccttggaggtggaggttgcagtgagccaagatcgtaccattgcactccagtctgggtgacagagcaagactctgtctcaaaaaaaaaaaaaaagaaaggaatttaagatgattttaacaaaaccattgtaacattgtaccaatgattttgtagttcagatttagctactttttactgtggtttgtcttcaaaaacaaatccaacttcttcacctaataggaatttggaaaatgttagttttttttttttgttttttttttttgagatggagtctcgctctgtcaccaggctggactgcagtagtgcaatctcggctcactgcaacttccgcctcccaggttcaagtgattctcctgcctcagtctcctgagtagctgggactagaggcatgtgccaccacactcagctaatttttgtatttttagtagagaccgggtttcagcatgttggccaggatagtctcaatctcttgacctcgtgatccgcccacctcagcctcccaaagtgctgggattacaggcgtgagccaccacacccggccggaagatattaattcttatatgtgtatgttcaacagatactgaatctcaggtgaagcaaagtgccttcatcattgtagcaaatcctacatttaaatgaaatcagataagtactggcatataatcaaaatttattttttatgttgattcccaatcaatgattttttttttcagacaacaacaagacataaagtacttattatggaattttgtccatgtgggagtttatacactgttttagaagaaccttctaatgcctatggactaccagaatctgaattcttaattgttttgcgagatgtgggtatgtttgtttatttatatgatatcatttgtatataaaatttaataacagaatttttaaaaaatatcttccattcaaaactgaagacctttatgcaatgcttcattagatatgacaccaaaagcacaaataccagaaatacataaattggatttcatcagcattaaacatttttgggcctcagaggacatcaggtaagtgaaaagacagcccatagaatgagaaaaaaatgtttgtaaatcatacacctgacaagggatttttatccagacaactcaacaataaaaagccaaataacccaatttaaaaatgggcaaaggattcgcatagacatttctccaaagaagatacacaagtggctaacaagtacataaaaaaaagctcaacattaattaattaataaccgacatcattggttattagggaaatgctcatcaaaaccacaatgaaataccactttataccaatgaaaatgactaatatcaaaaagacaaacagggccaaccatggtggctcacgcctgtaatcccagcactttaggaagtggaggccggcagattgcttgagtccaggagttcaagatcagcctgagcaacacagtgagcccctgtctctacaaaaaataaaataaaaaatagccaagcatggtggcatgcacttgtagacagctactcaggaggctgtggtgggaggatcacttgagcccaggagattgaggctgctgtgagccttgattgtgccactgcacttcagcctgggcaacaaagcaagactatctcaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaagatgaaaacagcccaaatgtccatcaactgatgaacagataaacaaaaatgtggtgtgtctatacaatggaatattgtttgtttacaaaaagatatgaagtagttatatatgctacaacatggatgaacttgaaaacattatgctaagtgaaagaagccagacacaaaggctgcaatattatatgattccatttatatgaaatgtcaagaataggcaaatccatagagacagaaaacagattagtggtttctgggggatcaggagaagatggagttgggtatgagttgtctttttggtgtgacaaaagtattctgaaatcagtggtgatggttgtataactctgtgaccatactaaaaatgactgaattgtacactttaaaaagatgaatgttatgtttgaattatatctcagtgaacctattttttaaaaaaaatactgcaatcaaaggaaataacatcttaagagaaatgaatcaaatatttgaggaatgggaaaaagtcaagtgataaggtaaaaggttggtgggaattcttgaacttgtcactggaagcagagtgattatttaggtgaggatacaatgagagagaaacaatattactagtatgctacagcctgtttaatcaaatagaaattatagatatgatgtcttcctaagtgtattggtagtcctgagttttaataattatacattgatacccctaaaccttttacatattttgaatttgaacattcatctatcagccctcaagcaaatgtataaagttatcactcagtgacactgtcagttagacaaaatagcttaatttcagcaaagtagacaactttgcccttaagaaaaaagaagaaaaaatgggctttttggaatagtgccaagcatatgagaatacatttttacagaaacaagtttgacactttgctgtttttctgtttcttttttgctgttttacatattgagttcagtttacttttagggaattttttttcccaagataaagaaatgtaaaactctggtgaaagattgatatcttttttgggaatctttattatttttatgtttaaacagatcacccacatatatataaccaaagtaattcaagaaatcatatgcttaagactgttttgttacattttcctggtagtacttaagagacactggatttttccttagaccacattaatttttatcattctaaaacttcttataactaaaacataacatcttttatatatatatatttattatctattctttgagtaaaattactttgaaccaaattatggaaaaatttatattaagtttgggtgactatatcaatgaatttgagacatgcacacatacacgtaaatatctacattatgacttcttttgttttatattgttgaagtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttggtaagtcatgtatcactaatattttcatttaaagaagcttgatatattgtaattataattgggtaattggtcagccaattcactataaaatgtcatttttatgacaaaaattaaattttctattctaatgaatatgtgcaacatgggaattaggtactcgcttccaagggtgctgttatttttctattaaaaattcttggaagttttgtagcacccttaaattctttagttttactgatgctatggatctaaattaaaagggtctgttttttgatgagcagtcagcatattacaagcttgttataatactgttttttatatattcattatatttatgaaacagataattctatttgggggagttggttattgaatgacgaaaaggaccattgttagaaacacacacacacaaaatgcccctgagaagatctaacttgaaattttagaaagctagaaaagctctgtagttgaaaaagtttatgtaggtgtgtttttgtaaagtcagtaaatatttgaaatacttaagaaaatatacttaaaagtaaatacttttaacatgtaatcaggaagtttaatatatatagctcactgattattcatggctttgggttttgtcttaaaagtcatagaatcaatgacttttttgcatttggattgtgctgttgtaattttataagatgaaagatatctaccacaccctgtagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaattttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaaattagctgggtgtggtggcgtgtgcctgtaatctcagctactttgggaggttgaggcagaattgtctgaacctgggaggtggaggtttcagtgagccgagatcgtgccactgcactccagcctgggtgacagagcgagactccgtctcagaaaaaaaaaaaaaaagtacctaaaaatggattttattcattcattgcacaaatatttatgaagtgcctactatataccagatactgttctaggtgctcagacttctatggtgaactacatacacagtattcctgctcttatggagcccacgttctggtagggaaaaaagacaattaacaagtaagtaaagtaaattcagatcattaaagtttagcaaagacaataaattaaggtaataagataaagagtgactagcaggagaaacatagcctgggaaagcctcctttgaggactaaatgaactgacactgaaatgataaaaagaagcaagccaggcacagcgttctgactgctgttctgtgccgttccctggccctgtgaaagctacctccccctgcagaaaagaaactcaaccaccagtcctcatactcctcggcagttccctccatctctgcttgctgagaacctactgcatcagtctagcctactgcatcagtctgaaccctactgcatcagtctagcctcctctcccctacaacctgtgttgttgagggcccaggatgcctatggggtcctctggctgtctgagttgtgacgtatgagctgctttgtgatacagtgaactccctgtcattgtggatctggagaatgtgtcatagaacctagatagcagagggaagtacagttgtaatgaattcaccttcaagcttcctgagactcttggctggaacagaggcaggactcagacgtttctggcgagtggaatcaggcttcatatcctgaattctccacgtgaatgtaagctccacaaaaccagggactttcatcttagcctaccgagaacaccaagcagaattagacaagaagaaatcacccccttcctgctcctttctccgtcctacatgacatttgtgcttttgctattatccttttgtctcttcctgggcctcaacatgtgactgagtcaacacacatcttcattctcatttctctgttggtggtcttctcagttatatttggctagaccatgctttctgcttctagaagcaacactgctgaattcacaccagagctttggtacaaggcaacttcctgattccttcactttccccagttcagacattccccttgtcttttctcttagagcagtgagcctccaataaatagctcaaggccatgttcttccagactgcctcctttccagtagcaagctcaagcgcgtgtccttcaaattcaatgattagataagataacttgttcaaaaattcaatttctctctttctctttctctcacccagtactttttttttttccccaaccccactttctgtaagaacagcctatttctaaaagctagttcaccaggcccagctccttgtctctggagcccacacctgtcatagccaaagccacagtagatgaatgctcaggacactactgttcccaggagggcactgcttgccaaggtttactgctctaagaatgttcttgggcttcagtctggttccatcaggcccagagaaaacagcagctgtaaaggcctggagacaagaatgacctcaggagttggagaaacagaaaagatggcagttttactggaatttagtgagtaaagaggcaagtggaaggacttagaattaaagaagtgatcagggggctagccagatcagacaggctagtagtttaaaccctgtcagaccaatacccccttgttataataaatattttgtagtgttcccttcagtatcttgaaatgaaattcctagataatattataaacctgcacacctaattaaaatagcatatcttaataatgtaaaggaacatattttataataaaataatagatatttaatatgtaaaaatttagaaacagcttcatgagcaaacaagtagtgatatatgcttgcagctatatgtaatactactttgaatacaagtgcagtgataactcatgttgtattagtgaatcacatcacaaatggtagtattgttattgacatgattttccaaagtagtgaacaatttttggtaaagtttctaactaaaagtaaatttaaatatagttacattcttggaaaagctgtacaaaaatactttgttatatataaaatggagttcgaaatagatttctcacttgcacaagtatctggcagaatattccaaagtcattcaggctatatataggaggatcatttttcagaactgtcacatacactgcagtatgtccttcagtgtctggtctccgccttttccaatcatgataatcactgtaacaagcaaacagcagtcctgtaccagccttcatgaggttgctcccccaataccaactattaatctttcatgtaacctcctgggaacacagtttagcttttgcctctaagacttttaacaggaagagcaaaacattaaataaattaattccaagtctgtgctgtactctaggctgaaatttaaccccattctatttatttcctatttcagaatgggaaatattcaaatacagtgcaccagaatgagataaataatagtctaaggctcagcagcctagctatattctacatttaactggaaacttccctcgttttgaagctcccaggaactacaacccatatgttaaattctctctcttttgtatgttaaagtccaaagaaaacattcttctactgttttttgtttttgttgttgttgttattgtgacagagtctcaatctgttgcccaggctggagtgcagtggcataatctcagctcactcaagctccacctcccaggttcaggtgattcttatgtgccagcctcctagatagctggggttacaggtgcacaccaccacacctggctaatatttttgtgtctatatatatatatgtatacttttgagacagagtctcactctgttgcccaggctggagtgtagtggtgccatcctagctcactgcaacctccacctcctggattcaagcaattctcctgcctcagcttcccaagtagctgggattacaggtgtgtgccactacacccagctaatttttgtatttttagtagagatgaggtttcaccatgttggccaggctagtctcaaactcctgacctcaagcgatccacccaccttggcctcccaaagtgctgggattacaggatgtgagccaccacaccctgtctcttctactgtttttaatatgatggatatcatctcagtaatataatcctgaaaaccttggagtagctttatccttatgctcttcttccagatgcaatagcccaggcccagtaacaccaagccagtaacacatcaggacagagccagtgggcacaaatgtatcagaccagcatgtgtcaagccaccccaagttaatcactcccagggaatagcttccagctgtaccaattaggcagtatattattgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgtgctgtgctacagaaccagcaaagccactgagatcccatatatctagtaggcatatgtttggacactcacgtcaatacccagttcttatacttgtctgcattctgatttctcattaaaatgtgtttctcaaaagagtctttttcccacccccatctccagcacccccccaccaccccgaccctcagaaatcagagattgtgatcctttgggagtgagagtcacagattgcatcatttagaagcccctcccagcagcatttcctacactggttcccagttccctgggccatagctaaatcctacaatgtcataaggaattgttttggtttgggatcatttaggtggtaactctactttggtccatacgtacacttttcaagatttatcttccaaaaatcttcaagttgcaagtgtataactttcatgaaggcagatggcaggaggccatgctgtgtgtgaccactggttattctctgcagaacaaaatgtccatcagaatatctgttaggttttgtgagctcctaaacaatttcttagaagctccatctgttctcagtgactatggtattagtgcagagtgtccaatcttttggcttccctgggctacactggaagaattgtcttgggccacatataaaatatgatagattatcttgggccacacataaaataatgatagctgatgagctattttaaaaaaatcacaaaaaacctcaatgttttaagaaagtttatgaatttgtgttgggccacattcaaagctgtcctgggctacatgtggcccacaggctgcaggttggacaagcttggtgtaatatgtcctatgtgtaaggacgtgtgtttaatgtcagtagatccccagtgaacccagtcaagttagtcctctgaattgattctagagaatttaatttcattaaattaaatgcacttaccctgacagattgcatttgagggataaggcaaagaaattaaggctgcctgataggtttcgggtgtgagcagctagatatgtggtggtattgtttacttaaagtttaggaggaaacaagtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagcattattgagtatccatttgtttgtataatgaaatgggtcacaggttcatgatttttttcttttttttttaatcttagcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtaagtggtttcccgatctaaaatcagagaagcatttaaaaaatgatttctgtcttggttcatcttattgttagtggtttatgctaataaaaattgatttaacaatcatttctgatattttaagctacctggtttttaaaaagaatgcagccttataaaagtttgcataattttatgtttaagatatttatgtttaaatatcttatatacacagtataaatggtattcagtctttggcccatcattaaaaatgtactgctttctagactttatttcagcacactgtttatttcactctgcatacttgtcagcactttcctcccatacaactgaaaaaaaatacatagttctgtggagtattagaatcattaccagatctaaaacaaacatcagtcttaccctaaagtgaactgattccttttaccatttaaaaaataacattttgggccaggcgtggtggctcacgcctgtaatcccagcactttgggaggctgagggaggaggatagcttgagcctaggagttccaagactagcctgagcaacagtgagaccctgtctctataaaaaaatacaaacattagccaggggtggtggtatgctcccatagtcccagctactcaggaggctgaggtggtaggatcacctgatcccaggagattgaggctgctgtgaactgtgattgcgccacggcactccagcctgggcgacagagtgagaccctgtctctaaataaataaatgaaagaaaattaaaaataacattttggcagtaatgtaacattaaacttttttttccagtgttgcagatttggaccagacacttgatatattttactagtataatgtatacacatttatgtattgtcacaatttttttttaatttccatttttattttagattcagagggtatgtgtgaaggtttagttaaaagggtatgttgtgtagtgctgaggtttggacttttgttgatcctatcacccagatagtgaacgtggtaccgaataagaagtgttcagcccttgtctccttccctccctacttttggagtcctcagtgtctgttgtttccatctttgtgtccatctttgatgcattaaataagtgggataattacaagaattgatttctgggattggcgagacaatatgatgggctccacagcacagatggaaaagttgtgaacgcaagatttagctctcatttataagtgagaacataacagtatttggttttttgtttctgcattagttcacttaggataaaggtctccagctgcatccatgttgctgcaaaggatatgatttcattcttttttatggctgcatagtattctacagtgtatgtgtaccacatttttgttatccagtctgccattgatgggaacctagattgattctatgtgtttgctatcgtgaatactgctgggataaacatacaagcgcatgtctttttaggtaggatgatttatttttctttggttatatacccagcaatgggattgctgggtcaaatgatagttctatttttagttatttgagaactccaagctgcttttcgtaggggctgaactaatttgcattcccaccaatagtgtataattattcccttttctccacaacctcaccagcatctgttacttttttttatttttttatagccattctgactggcgtgagatggtatctcattgcagttttgatttgcatctctttgatgattagtggttttttcatgtttgttggcagcttgcgtagtcttctttttttttttttttttttttttttgagatggagtctcgctctgttgcccaggctggagtgcagtggtgcgatctcagctcactgcaagctccgcctccctggttcacgctattctcctgcctcagcctcccgagtagctgagactacaggcacgtgccaccacacccggctaattttttgtattttttagtagagacggggtttcaccatgttagccaggatggtctcgatctcctgacctcgtgatccacccgcctcggcctcccagagtgctaggatcacaagtgtgagccaccacacccggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcctgaattatttgcctaagacaatgtatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtatctgtttttgtaccagtaccatgctgttttggttaccgtagctctgcagtatagtttgaagtcaggtaatatgatgccttcagctttgttctttttgcttaagattgccttggctattcaggctctgtttttgttccatatgaatttagaatagttttttctaattctgtgaaaaataactgataatttgataagaatagcattgattctgtagattgctctgcgcagtatggatattttaatgatattgattcttccaacccatgcgcatggaatgcttttccatttgttgtgtcatttatgatttctttcagcggtgttagttcttgtagtcatctttcaactcctcagttaagtgtattcctaggtatttttgtgtctgtgtgtggctatggtaaatgggattgcgttcttgataaagtctcagctttgtccgtgtatagaaatgctactgattgttctacatttattttgtgtcctgagatttggctgaaattatttatcaggtctaggagtcttttggcaaaatctttagggttttctaggtttagaatcatactgtcagtgaagagagataatttgactacctgttttcctatttgaatgccttttatttttgtcttacctgattgctctggctgagacttctagtactatgttgaataggagtggtgagagtgggcatccttgtcttgtctcagttcttaaggggaattgcccattcagaatgatgttggctattggtttgtcatagatggctcttattattttgagatatgttccttctgtgcctagtttgttgagatgtattgccataattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatcttttgttttgtttgttttgtttttttgagacagtttcactctgttgcccatgcaggagtgcggtggcctgatctcagctcactgcaacctgtacctgccaggttcaagcaattctcctgcctcagcctcccgaatagctgggattacaggcacccaccaccatgcccggctaatttttgtatttttagtaaagatgggtttcaccacgttgcccaggctggtcttgaactcctggcctcaagtgatctgccccccgccttggtctcccaaagtgctggcattacaggcatgagccaccgcacccagcctggccctatcttttatgaagcaaacctgacttaaagtaataatcacaactgtaaaaagacaattatctaatctcttctcaaaaaattgagggagaagcatgtttttccttttgttggttggaggaagtaaaacaaattcagatggtacaatgactttttctataacttgggtatttaagtgttttccagcaaggacagtgtacatatttatgggaagaagacacctatttaactgtactgatgattttggcatagcatcctattgagcctgctttatgtcattgcccttttaatgaaatctcttcattaataaaaactgataatttgtgtttttctcattacacataaattgtgcctaacagttaatcatacttttttcatcatagatagtatcagcctttaaagcaatgtcagcatttcttgctgccctaaaaatggtttaaataaaagtgtgtgctgctcactaataaaggaaacatgtgactcataagcagctaggaatacctgatgattttatctgacacccttgtgggcagatataccattagaagaattttattttattagcacagaaactcaactttttatgaacattgatgctaaagaatgttcagaggtgattgaagtactcagtaataataattgttttactttactaatgaaagatatattcatccaacattatagtagtgctgattcctcagcatctcatttgcatgttatgaatgtacttatatgtggatcttatcaaaattaaacttttttaaaacttgtaagcattcccctaagacttttgccatttattctattcacttctcttttgcattaatcccacacatgtgcacttacttcttagatagttgtcacatgaacacaccttatttttcacgttaatttcctctttgaaaaatctcttaaggcagaaatcctggctgccactgctgaggaagcagcaaatggtctaaatcagttgtggtggtttgttctattttttaaaaaaataattaatttgctcaaagcacatttactttaatgttaaacaaatgtgctttttccaaaatgtgcaaatgtgtgttttccagtgtgcaaagaatctgatactgtgctctatatagtataatcttttttgttttaaagaatactattcattctgcagaaactttagttgtgcctttggataatatgggtaagagggattatatgctttttttcatggtctagagacattctgtgacacaacttattttgtgtttgctcagttttttcagatggaaaaattaatatatttgttgtgaacatcaagatgctgttataaagcactgtgagatctcaaatgaaaattaattatggcatatataaataaccgtacaaccactattgtacttcagtcagtcagattcaaagtattttgattgttttatggatcctgtgagcatcaatcacaaagtttcatctagtagataattgtaggtgcaattgaggaaatacttttgcaaagcccattaataagtcatgcaaaaatgaactgcttattttattctgcttttgttcctcccaaggtataaaataattacaggaaagccttctggtgcaatatctggagtacagaaagcagaaaatggaccaattgactggagtggagacatgcctgtttcttgcagtctttctcggtaagtatggtgtacctaattctcatcttttgcactttggtgtttgaaatctttgttgcctagaaccacagatactcaaatactgaagtgtagtttgattttattttaattagatattgtcaaagcatgtgctttgataaatgatttttgtcttcgtggtggtgaaaagatttattctctgctatatgaataatttcccaagatcttcattaggacacagggcatacatttttgagattggtaatcactggtcttggaattcttcccagtgtagggatcatgctcaggaccttagtatcttttgtaatgacctccatattgatggataacaaatagtggattagatatgagtaaatttctcaactggagttgtaaaaagcaaacaatgaagagatttagtattatcttcattttaaaaaattcaaattattcaaagggtgagaaataatagttttttgtactttttagcatttcaaatgttcatttgggtcttgtttaatgtcacagacagaaatcaaaaaaattatattgtcatttaagaatcctgttaccacaaagaaagaattaaggtaaaagaaattaaaagtagaaagtaaattattttgtatttcactctggaaacaaagccaagacatgcatcggtatttagtatctgtgattactgaattagcttccatttttcttgagtgtggtagttatataatccttaattggacacaagttatgaattagtggcttatcaccttttttaagttgtgggtgctttttgtatgactttaaataaataaatatataaaacaagctaataaaatatcacttatcattttatatgttgggttctgtgaaaattcatttaaaccaagagttccaatgctgaaatcattttcaaaaaccactattgttaacagttttttgtgtgtgttattttaaaaagtttccaaaatgaaatcgtcatgtaactagattactaagagaaattcattgtgttggagagtagaaatttaatattataactgtgatttgtgttaaatttttatttaggaaatactcattttggggatctcaggcaaaactgataaagtgtaaagggctcagaaaatgaacacttgctggtaaataattatattgccaaaactcagaatcaaaaaaatctgatgatctgaactgcagcatatttctggagggtaacaggcattatctatcgaatcagtctttagcataccaagttacaaattctttgagaaaaattgcttagatgccagaaagtatattatataatttttttgttttaaatagtaagaactctaagtactacaaatcagccgtgaaaacaactaccagaaatgtaatgggtcttggcacggtggcatacacctataatcccacctgctcaggaagctgagacaggatacttgagccccagagtttgagactgcaatgcataaagcatctgtgaatagctgctgcacttcagcctgggcaacataacaagaccccatttctagaagaaaaaaagctataattccttattcattgatgagtggcattaaatgaaggttacctagctttctgaaaagttgacagattttaaattttttaaattaatctaatatagtaataatgacagttcctttgatttgctggtaaatactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttcttaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtgatgttcacacaatgatgcagtttttagaactattcccatcattaagcaatgcatgactgtacacatacatatacttgcatgtaaaactggggaaatttgagtaagttgggtgtatcaatgttaatagctggttgtgatgctttgctatatgcaggatgccaccattgggggaagctgggagaagaatatatggtgtctctcttcatcatttcttagaactgcatgtgaatctacagtgatgtcaatgttttgtaaaaagctcacccagtgtgattatcgttaataataacttaattgtacattttaaaatagctaaaaaaatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctgaaacatttcttttgatgtcattgatctattcatggggaagctgtcttttcccccgaagcatcattttgaaaatacctagttttattaatgtatttaacaaacatatagtcacataacaagtgctgttcttggttctttacatatttaagccatttaatcctcacaacaattctgtgaagtgggtactgttattatttccattttactgatgaggaaacagtgcagaggagttaagtcacttacggttttataggaagttagtggaagagctgagatttgaacccatgtatctgattcaagtcagtgctctaaaccgctctgctatgttggttctctatttgaaaatattaataatcttggccaggcacagtggctcacacctgtaatcccagcactttgggaggccgaggcaggtgtatcacttgaggccaggagttcgaaaccagcctggccagcatggcgtaaccctgtctctattaaaaatacaaaaatcagctgggtgtggtggtgcatgtttgtaatcccagctactcaggaggctgaggcacgagaatcgcttgaatccaggaggcggaggctgcagtgagtcaagatcgtgccactgcactccatcctgggcaacagagcgaaactctgtctcacatacacacacacacacacacacacacacacacacacacacagaggaaagaaaatattaagaatcctgtatattacacaggtatccaaacataaaaatactttagaattgcttactgtatggacaggttatatggaatggagtttgtagtatccacattaacaaagcaagtttatatggactggttatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaagtaagttgggatttttcttgtcgttcttactagccattagaaaaatacagccagcctgggcaacatagtgagaccttgtctctacaaaaaaataaaacaaaaattagtggggcatggtggcttgcacctgtagtcccagctgcatgggaggctgaggtaggaggatcacttgagcccaagaggcagaggttgcagtaagccgagattgcaccactgcactccagcctgggagacagtgtgggaccctgtctcaaaaacaaaaaaatccacaaagtctgtcattgtagaaatgattgtcatccttataaagctgatgataatattagtgtagagctttcataaatattaaaattttataaattactatagttgaaagagagtaattgtaaaattgaaaaagccttgtagacatgatttgacttcaaatattttgtttcctaaaacgataaaatcgtttgtcatacgtttcactgtaactctctttaaaaagtgttttgctaacactcaaaattaccttttatatcataaatttcagcaaatattttttgtgtgcagtatgtatagaacattgtgccaagctttagagtctaagaaaaattagatctgcatttttagaatcttttaaattactcattctactggtagaaaaaaaaatggatcacccagaattttacagttctatttgaaggttgggatttgatgtagatttaaagagaagcattggactcattgtgttggtgtatatttaaggaaaaaatgaaactccttagaaatatttgaggtaatttgttagagaatgagcattattgtttgaagtggtgtttttttaatcacgaaaactacattacagattttgccactaatgtttaatttagacattgtgtttgctctataaaggataaagtgattttttcaaaaagttttctttctcattttattttacttcatatttcagtttccctccctaaagtacatccacgttatgatttagacggggatgctagcatggctaaggttagtatttaatttaattactatgtaaacatctgaatttaatgtatcctatcaatagtggaagcaataacatgtattgtgtcttcatgtatgtctatatgacttaggaaattattcacttaaattgataccctttccaagtgattttgtggtctttcttttttactttttatcctttcttgaattcattatataagaaaattctctccattgagatagtgcatgtttagataatgttaaggataacatatttattatatttatatctatttttaactcttagaaattggtggtttattgtgtttttaattaacctgataaaaatgtgtaagcttgaataattttgtgtaaaagtttttcttaccctataccacaattagcaccaaatattgacattttatttctttattaggcaataacaggggttgtgtgttatgcctgcagaattgccagtaccttactgctttatcaggaattaatgcgaaaggggatacgatggctgatgtaagtaatagattgaaattttgaaattgattttcatgtagaccttgccccatcattgatattttctctcttcaaactagttaggttaggtgcttgatttttattataatacatttgtttcacatttagtttataaaacatttagcagctcatttttcatgagtcctacaatgaccttgtgagacagaacaaatagtatctgaattttaaaacttacaccacgctataggatgtgacggcaaatgcatttcttttcctaggaccttgagtagttggttgtcatttaactatgttagaagtctttggcttgttagaattcagtacaatctgtactttctagcatttaagtcctcaaagtcttccttaatttcctaccattttcccaaatgaagtacacagtccttttttatcacaccgtattttttttttttctttttgagacagggtctcgctgtcacccaggctggagtgcagtggcacaatcacagatcactgcagcctgaaactcctggcctcaagtgatcctaccacctcaccttcccaagtacctgggactataggcatgccccaccacacccagctaatttttttttttttagtgatggggggtctagttatgttgcccaggctggtctcaaactcttgggctcaggcaatcagcccgcctcagctgggattataggcatgagccacacccagccttcacaacattgagatataattcatatactatataactcatgcatttaagcatacagtttaatggtttttattatgttcagagttgtgcagccatcatcactaattttagaacattttcatcaccccagaaagtatctctgcatccattagtattcactctccatctccgcctaaacagccctgccctaggcaaccactaatatactgtttgcctgttccagacatttcatataaatgaaattatacaatatgaatatataatctaacaagcaatttaaaagctaattttttaaaactagatcgcttaatatagttattctagttcagaataactggttatctagtttaagtagtttcttcctgaaagtgactctaagaaatgtaagatggatgtaatttttacctgttttttactttaatgatttatagatgtcatctttccatctgaaaaaaatggaaaatacattatctcttttggaaattatgcttgtttctacacatcattcaaagcttttgaattttgcgtacacatcatgatggccttgtggccgacagatgttaagaagtttgttttctgcactcatgtcgctatgtatgtgcccttggactgtaatgcttttgacagtttatgtatgcctacctcatacccaccccgtcttgcaaaagtgtgtatgaagcatttcatcactctttttaggctcctttttttttctgttagcattatatgaaacccataaatttgtgtttatctttttcactgtgttcacatatcttagttcctaagcctatgcttttctgtttccactaagaagcttccttgtttttactggtttctggaaaaatctctgtgtactaacagtttttattttctcttatctatcgtcaattgctgatccatgaagcttttattccttttacttattagtttatagtccaataagtcatgagaaaatagttttaatgtaaaccactgttggcaaacattttctttaaaggatcagtctaatattttagactttgtgagctgcatatggtctcttctttgtttttacaatctttaaaagtgtaatgttagctcatgggccatacaaaaagcaggcctcaagtcttagtttgttgatccctgatgtagatcaaaagcccttcaattatatatttcttactgtgtcatccttcttcagatgacatcacaagttgagcatccctaataaaaaatattccaaaagtcaaatctttttgctcaaagtttatgctcaaaggaaatactcattggaacattttggattctcagattagggatgcttaaccagtatgtatatatgcaaatatcccaaaatccaaaatctgaaaaacacttctggtcccaagcatttcagataagagatattcaacctgtaattggtttaaagtataaatcagacagtagtctactctgagtagtaaaaattaattctggtggtataaactgtaatgctctacaaactatttgtgtaattgtagattagtttttactccttaatgtaattttaataccttaggtttttaaactgttaacctaagtagtaatggtttgtgaaaatatgagttccctaatacatcaggatcacagaaatgcttattataataatgtttcaaaaagtgtgaattgatgaatatcatgaatattgttataaaatgtttttgaactgtagtactgcagtataattagtgatagatagaaaaaataactccttagataaactaattagaataattttctttttttagtgaattaattaaagatgattacaatgaaactgttcacaaaaagacagaagttgtgatcacattggatttctgtatcagaaacattgaaaaaactgtgaaagtgtgagtagactacttccttactagtaggggttaaattattaaatgttccatttctatttaaatgacttagttatccttggcacaatatggcatgctatgctagggtttctattaaagatcagcggcctggcacggtggctcatgcctgtaatcccagcactttgggaagccaaggcaggtggatcacgaggtcaagaaatggagaccatcctagccaacatggtgaaactccgtctctactaaaaatacaaacattagttgggtgtggtggcgcacgcctgtagtcccagcaactcgggaggctgaggcaggagaatcgcttgaacccagaaggcagaggttgcagtgagctgagatcatgccactgcactccagcctggtgacagagtgagactccatctcaaaaaacaaaataaaataaagatcagccttagattagtgattactttatcatcacaaaggcaaaaatgccagttttcttggtaagaagtgaacaccatctcttagtggcatttcctcccagccattgggcaggaaaaggtagtgggaaaaacatctcatttctatcttgtaaaacagaaactgtgaataagaaaatatgaaacttgtaatcaacaaaggaaataggaagagatattctagaacagccttttagtagtatttttagaattataggaattacttttagtttatttttacttgttaatcttattcctgagaacacgttttgaaacagaatgatatttttaactgccctctttctagaatatactatttgtactgcagaggaaatacaataaatgaaatcagtattcactattgaccttcattaattctgaaatgtatttttactattatcctcatataagattatttgaaattaatttgtcttttctgttttatccatcccttaatctgcaaatttaaaatagaagcagataaaattccttcttcaggaaggcatcaggtttttttgtttttttggtttttttttttttgagagagagtctcactctgtcatctaggctggagtgcagtgatgcaatcactgctcactgcaacctccgcctcccaggttcaagcgattctcctgcctcagcctcccaagtaactgggactacaggtgcatgccaccacgcccggcttattttttttttttttgtatttttagtagagatggggttttaccatgttagccaggatggtctccatctcctaacttcgtgatcttcccaccttgacctcccaaggtgctggaattacaggcgtgagccactgcacctggccggcatcaggttttttttttaacaatctgctggcttatagactttgaatcaattttttatttttaaatggttatgatgaaagctgaaattattatttataaaacatctttttaaaactatgtattgattatactcatttaattttctcttttgacttttcatacagatatgaaaagttgatgaagatcaacctggaagcggcagagttaggtgaaatttcagacatacacaccaaattgttgagagtaagtgtttacaaaattacgaaatttgtaagctcataacctattcctttgctggcactattagatttaaactttcttaggagctaggcatggtagtacacacctagagtcgcaactactcaggaggccgaggcaggaggatcacttgagctgaggcattaaaagctgcaacgagttatgatggtgccactgcaccctagcctgggcaactgcacgaaatcttgtctgtaaaataaataatttaaataaataaactttcttatagagatgatatttctcactgcagagaaagaatttttcccatctttagaaacttctttacaatattaaataatcttactgccttgaaattttttgtaacatattcaaatgactactgtaatttaaacctctctcgctgcctctctctctctcggtgtttaaatccataatgctcttgtgttcttgctgtggcagttaaagcaagttcataaatgtaatttcacatgcagttgaatgtaaagtgcttgagcttgtttagaaatagatttaaattaggctgggcgcggtggctcatgcctgtaattccagcactttgggaagccaaggcaggtggatcacctgaggtcgggagtttgagaccagcctggccaacatggtgaaaccccgtgtcattagctgcgtgtggtggtgggcacctgtaatcccagctacttgggaggctgaggcaggagaattgcttgaacccaggaagcggaggttgtagtgagtcgagatcacaccattgcattccatcctgggtgacaagagtgaaactccatctcaaaaaaaaaaaagatttaaattagaaaaatattatcagatttttttctaaaataaaaaaggaaagaaagatttgaggtcttcaaggcagtaattacttctatagctagaaaaagaaattaggacacaagtctctactctgctgaaaaatacaatagaacttctgggagtctctgaatctcttattaacatgtattatagaagtgcgcaggtttatatattagtaatcagtgagagctgattactactcccagacctgccccatttacctgcctactcatgactggctacttaagcaaggccttttaattctttgcatccttggtttctttttctctaaaatcagcaatttcttaccctgcccgtcttatgggttgttgtactaattaaatgagataaataaaaatactgtactcttggctgggtgtggtggctcacacctctaatcccagcactttgggaggctgagtcggatggatcacttgagtccaggaattcaagaccagcctgggcaacatgatgaaaccccatctctacaaaaaatacaaaaaaattagccaggcatggtggtgcatgcctgtggtcccagctacttgggaggctgagacaggaggatcacttgaaccgaggaggcgaacgttacagtgagccgagatcgtgccacttgcactccagcctgggtgacagagccgagactgtctcaaataaataaataaataaatatattgtaatcttgcaagcttttagtattcgaagtattctttcataaaatggatgttaaattaaaagtgaaaggaacttgatacgatatccttttcactttccagcttaggctgatgtttgtttcttttcctcagttttagatctcaaacagtggttttcaaaatatgagtaatgaacaactagtaggttatgaagttgggtgccttgtaatcagcaatgtatttttcagtggaacagaatagaaaatgtcagaatgtgtcacatataataaggaaatcattgtttatgaaactttgattcaggtatatacacactttaaatgttactgagttaaaacagtgagtttcttactatgagttgtggtcaggaaagtttgaaaaccatagctatagaataaggtgattaaaagtcagaaagcacaaaatagtcttccccagtatttgtctgcatttaaatataggcagccatattgctgtcagtgttttatattcttctctgttttcaccttagaacatgatttacctgctcataggcctagtggacatttatttccagggccagcatcgtttgagcactttaaatcaaaattaatatattttcttttggggatctcaaaatgtttctcatttttatgacattcctgtgagattaagatttctttttatttattcatttatttttaaacagagtttccctcttgttgcccaggctggagtgcagtggcgcgatcttggctcactgcagcctccgcctcctgggttcaagcaattctcctgcctcagcctcccgagtagctgggattacaggcatgtgccaccacacccagctaattttgtatttttagtagagaagtggtttctccatgttggtcaggctggtctggaactcccaacctcaggtgatccgcccgccttggcctcccaaagtgctgggattacaggcatgagccaccttgcctagccaagattaagatttcttatgagaaagcatagatgactaaatagcttgaggtaatggagtcttatgacatcaggacttctcacttcaagccaattacttttccgtagatatcattttttctctttttcttttttttttgagatggagtctcactctttcgccaggttggagtgcaatggcgtaatctcggctcactgctacctccacctcctgggttcaagtgattctcctgcctcagcctcctgagagctgggacttcaggcgcccgccaccacgtccagctaattttgtttgtttttttttttttttttggagacgaagttgctcttttgcccaggctggagtgcagtggtacagtctcggctcaccacaagctccgcctcctgggttcacgccattctcctgcctcagcctcccgagtagctgggactacaggcttccaccaccaggcccggctaatttttgcatttttagtagagacggggtttcaccgtattagccaggatggtctcaatctcctgacctcatgatctgcccacgtcggcctcccaaagtgctgggattacaggcgtgagccactgcgcccggcttcgtagtggagaccttacagacatttttcccaccacaaaagtaaaatttataagtagaaaaaaataccacatatattatgcacccaaaaaatgatgcttaaaagttttgtccattgccctgcagcagtgcttctcagagtggctcctgggccacaggtcgcagtggttcacacctgtaatcccagaactttgggaggctgaggtaggcggatcacttgaggccaggagttcgagaccagcctggccaatatggtgaaaccgtgtctctaataaaaatacaaaaattagccgggcgtagtggcagacgcttgtaatcccagctactggggaggctgaggcaagagaatcacttgaacctgggagatggaggttgctgtgagccgagatcatgccactgtcctccagcctgggcgacagagaccctgtctcaaaaaataaaaaaaaagtaaagaagagtggctcctgggccagcagcttcagcctcacatgggaacttattagaaatgcacattttgggaccccacctcggatgtgttgagtcagcaactcactggcagaacccagcaaaggccctttttaataagccttccaggtgattctcatgctgctaaaatctgggtaatcactgttttcattttcttttatatgtattattaaatgactgttactctacaaacatatggttgttatttttactttttggataccattatagtgtaggcatttcccaggtttttttggtaacaccattttcttaatgatatgatgttgcagccagtggatttattacagtcttacttattattgctctactgttggtcctttagtttgcttttcactcttctatgtaatgctgtaagaaatgactttttccataaactattttccatatattggatgtataatttaacacattctaaacattaatgttaaaacagacataaagcataaaaaccgagatatatatttgatcatataaaaatttaagctgggcacagtggctcatacctgtaatcccagcactttgggaggccaaggtgggggtagactggttgagctcaggggttcaagaccagcctgggaacatggtgaaaccccaactctaccaaaaaaaaaaaaagaaaaaaaagaaaaaattagcaagacgcaatagcacgcacttgtaatcccatctactcaggaggcttaaggtgagaggatggcttgaactcaggaggcagaggttgcgggagctgagattgcaccactgcactccagcctaggcgacagaatgagactctgtttcaaaaataaaataaaaatttaagatctgtacatgtttaaaaaatgttagaatgcaaataagttgggaaaatgtgataaagggttttttataaaaaataactcatacaaattgataaggaaaatagtcaatctgcaaaaaatagatgagcacagaacatttagagacaatttataaatgaagaaaatatatctggtgaaaacactcttgaaaaaatgctcaaatccaatagtaagaaaaaattgcataacagtaagatactatttttgtctttcagattatcaaggcttaaaaaattataatgccagtgctgacaagagtgtggtttaaagggcatccttatttgttgctagtggcaatgtcagctactactgacaacattatttgaaaggcaatagtgtgtatcaggacctttaaaatatatggacatatttatcctttaagtctaaccttcatcctttcttcataagttttacaaatactgtatgcatttctgtggtaggtaagtgataaacttactaagcttaaaatgaacagaatcttagatgaggtttcttttcattttctgtttttaagaggagttgctttggtttggcctctaaacaagaagagcacaaatcttgctgcctacacagttgatatttggaactattctagtggttctatttaattttcaaaaccgggttatgaaatggagaattaaccactttttacagataaggaaacaagattagaagtattttacatgtggttttagaagggtgtttactgaatgaactgttttataagatgtattactgctggtctcatgttttattatcatactgtacccctggtggaaatcaacctaagaaactcttttgtatttaaaaatggaaataattactgtgcctttgaattgaagtaatctacaaaagaaatgtggtccagactttagactttgttgggactgtgatgatcatttctggcttttggcaatctggatctgaacctttggttttatttagctttccagttctcagggaacaatagaaaccagtcttcaggatatcgacagcagattatctccaggtggatcactggcagacgcatgggcacatcaagaaggcactcatccgaaagacagaaagtaggttatagctttatgcgtagtttctgctcttattaatgtcctttttcacattgactcagttaatttatttgagtttttcttccttaaatagtgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaagctgtttttttcagagatgtgattctgtcaggaaaaaggttgattgtgttaaaaaaaaaaaaaaaaactatccttaaaatcaaccttttgaatactttaaatcagggtcatgaacaccagaacctctaaaggccaggcaggtaacagaaaggaatgagattggccagtggggactcatctacaggggagagccactactcatattcaccaaaggtattgcccaatcttcccatttctcaaaaaaagctagaaatacagaatttgttagaaataccttgatttttaaatgttaactgttaattgttttttacattgttatttacagaccaaataaaagcatctgtgggccataagtaaccaatgagccacaaatctatgacatctgcttcagactcttagcctttttgaagcaataatctcaaaagaaaatacattgtgtataatattatgattctatattaacaacagtaatatattttcctatttctaggattagcttataatgaagaacaaatccacaaatttgataagtaagtatccagattatgtttaatagttatttttggtgctattttggttatctttattaatatgattcttcttaaagttgaaattaattacaatttaaaaatacattttaatcttgattttacaggattgttacaatatgtagacatttttgaggttcacacatctgctccctaattgggaagttaccatgatgggagaaggaggggggagaaagattaccatttcagtcagtcagcttctgcctcatatgctctgattacagaagtacagataatacagcacataggcaagggcagacttaactaccgtcttaattttaaccgcattcaataggcattttttttacatccattttgaaccttctctttatcttcttgctgctataatgtctatcttagaaacgtttactttctcctgtaaatattctaaagccacaacaatcattataggaaagatacatttcatatatttgaaaatttctaaatattgaaagtagaaacagtgacattggtttaagcctctgattatttctaaattacaggcaaaaactgtattaccatgccacaaaagctatgacgcactttacagatgaatgtgttaaaaagtatgaggcatttttgaataagtcagaagaatggataaggtgagtaaacttcttttggagtgattagtggttgactgcacaatataaatgtatatttgaagtaagaatgcttcactagactgcatatcaattgattctttttggttttcagaaagatgcttcatcttaggaaacagttattatcgctgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattgtatcatcgatagttttgaaatcaaaatttaaagtttttttaaaggacttattaaaagctgtaacacttgatgtcagatctgtagtaagtacttttgttctgtgattaatgtggggtttttttcttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaacatttgcatactgtttttgagcaaaggtgcttgtttattttattagtatgaagaaattaaaggaagagatggaaggggtggttaaagaacttgctgaaaataaccacattttagaaaggtgagtaatgcaaaaataattactgtgattttctgtgcaattgagttcattcacatctgtacttatatcttcctgtatcaatagattcagcagtggtaaagggtcataaagtcagaactcatgtttttctctctatgattgtgtatctgtgatgccttttaatggttgattagttccattttatagaagcactggttaatcgaattacttatttgaatcagtttgtaaagatcaaactctatttacattatttttataacttaattcattggaatcataattttcaatttggtgaatcagagttgctttttaagataccagcactttggtgctgagtagcttacggggtcctctgcacacctccttgcaggtgaaagccacaggtaaatgcagtactttgaggagttaggtgtctgcttattatctgcaaaatcctaatagataaggccaaagagatttgaaagcctgcagaggcaataaagcaatttttggatggcagttttccttatcctgattcctcagagaaattaagtcatatttggctctgtaatagaaccttttctttttcaagcccttaggttctcctctataggttctcaaacgcttgtaatgctaataaaaatatttcacatttggccaggcacggtggctcacacctgtaatcctagcactttgggaagccaaggcaggcagattgcctgagctctggagttcaagaccagcctaggcaacatggcaaaaccctgtctctaccaaaaatacaaaaattagctgggcatggtggtgcacacctgtaatcccagctactggggaggctgaggcacgagaatcacctgaatctgggagatggaggttgcagtcagccgagatcacaccactgcactccagcctgggtgacagagtgagaccctgtttcaaaaaaaaaaaaatggatatggaatttttgggtcagagagtatgtcaatttcaatttttgttgggttttactaattttattctttttttttttttttttttttcccccgagacggagtttcgctgttgcccaggctggagtccaatggcgtgatctcagctcactgtaacctctgcctcccgggttcaagtgattctcctgcctcagcctcctgagtagctgggattacaggcgcccaccaccacacccagctagttttttgtatttttagtagagctggggtttcaccatgttggccatgctggtcttgaactcctgacctcaggtgatccacttgcctcagcctcccaaagtgctgggattacaggcatgagccaccgcacccggccaattttgttctttaaaagggtgcatgttatagtcctaagcagataaaacctatgcatttggcaacattgaatgtataacatcttttaaacattcgccaatttgtttagtaaaaaccgagatcttattttaatttatatttctgtggtttatagtgatgtcaaacatcgtttaatatgtttgttcaattttcatttttggggagagttactcgttaactttaaaaaatattttccttgtttatagtaattatctaacttttatagtatccagtttacagtttcttcagaactttagctaaatccttttaggcttaaagatcaccaagtagaagagactataaagatgtgctttttttttttttttttttttttgagatggagtctcgctttgtcgccaggcgggagtgcagtggcgcgatcttggctcactgcaacctccacctcccgagttcaagcgtttctcctgcctcagcctcccgagtaactgggactacaggcacacgccaccatgcccagctaatttttgtatttttagtggagacaaggtttcaccatgttggccaggatggtctcaatctcttgacctcgtgatccacctgcctcggcctccctgagtgctgagactacaggcgtgagccaccgtgcccagccaaagatgtgcttttaacttttatatttaactacttatgccttgtggaataaaatcccaacttcctaaaccacatttagtaagtcagttcctcctgtgttttatttgcaggtttcttgacaatatataggtgatataacatggcataatcttaacgtaaatgttaagtgacaaaactagtaatggaagccagattttgttcagagtattatactactctgtctccatgtggataacccactatcacttcaaatttttttttgaatctaaaatcatctgtcccaactcagttttctctctgctccttatcctgttcaaaggtaccacctttctcctactcccttaaacataaattattttagacacttaatcttctttataccctctcaacaagtttggctcccatatttcccctcgtcaccctcattcagatctcctttccctttcatatgtgatatatggtaataacctattttttttcttaaccccaagctcttcccatctgtcatgggtattacagccaaaatcatctttcagaatactgatgtaatcgtatgacttctttggctcaaaagtttctaaactcctgttacctaaaaagtcaagtctaaatttatacttcaattcaaagagtgtaatagcctggttccagcctgttcacccaactttacttcccactgctccccaaaataacattgtgttctagcaaggtctcatttctcaacttcctttgggtatgtcacactcccaactcggtatctttttttttttttttttttttttgagacaaagtctcactctgtcacccaggctagagtgcggtggcatgatctcggctcactgcaacctctgcctcccgggttcaagcaattctcctgcctcagcctcccgagtagctgggactataggcacacgctaccacacccagctaatttttgtatttttagtagagaaggagttttgccatattggccaggccggtctcaaacttgtgacctcaagtgatctgcctgcctcggcctcccaaagtgctgggattacaggcgtgagccactgcgccggccccaattctatcttagcttataaatcccaccccaccagaaagaaattatccagttcttactgacagtttcttaattacatcattacatcggtttttcatgtatttatgataataccatgctgttccagtaagaaatagaacaaatcatagttacttaaactctttaaaaataaatagctatttattcctctgaaaagtattttaaggttgggggcctttatacataaatgcaacttttgagattacctttttttctttgtgtgtgtgttttaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagtt

SEQ ID NO: 992 - DNA, 44312 bp, Homo sapiens
gcccgcgggctgccgcccgcactctccaagagactgctggcgccggcgcccgcccgcgcggcaccgacgcggggagcgcgcttcgcgctgactcagcggcggcggcggctgcggcggcggcggcggcgttagccggccctcgcgctctttcccttcctggggcgccgaccccgcccgcttgcttgcttgcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaaggtgactcggggctcgggggcagcgggaccgggaccaggtttggtccgcgtgaggcttcgaggaagttggccggggcggaccggcccgggggagtcccgacgccagggagggtgcaggcttgggaccctctatggcggtgcaccccctggctgggcggaccgggtgggggtgggtacgagccggggccgccgccgaggagcgcgtcccgagtgcgtggccggcggttgcttggtgtttcatcacccgaattgccacgaggcttcctttaggggagggatcgggggagggatgggagcaaggctagcagaggagggtcggcatcgcctgtggttccgaagcccgttagtcatcgttgtagcgttatcaactgtggagacctcaaacttgattcttcccccacccctggacaaaaaggaaaagtgttatttctgtgcagtaattggccagcacggacgctccatttcttctcaaaccttcctcaccatcctgcaggactagagaagcatgaggtttccctgtaaccagaaaaacgagtactttttgaaagtgctaattagttgtggcgggcgggggttgggggagagttacgttttattaaaccgacttgtcagcgtggtgttaaaaggctggaaagattcagtcgtagtatttgaaacagtcttcagtaggtgtagaggaatttttccaaattgtttgattcttaatggctatccaggaaaagttaaggcttaatattttaagtatgttgcttgccttcccccaagaacctttgcaagatgcataattgtttaccgtattgaaacattttttggggttttgttgttgttgttttgagacggagtctcgctcggtcgcccaggctgcagtgcagtggtgccatctcggctcactgcaacctctgcctcccaggttcaagtgattctgcagcctcagcctcccgagtagctctattacaggtgcgccccgccacacctggctactttttgtatttttcgtagagatggagtttcaccgtgttagccaggatggtctcgatctcttgacctcgcgatccgcccgcctcagcctcccaaagtgctgggattacaggcgtgagccaccgcgcccggccttccactgcatattgatcgtccaaatgccttctatgtgggggattctttctgtagtgacaactgttaactagtttgtttccttgggtttattggctatgttttccttagggccacttcatttttctcccgatagcttcagagtgacttgaccaagcttaagcactttttcttttttttgacacagtgtctcactctgtcgcccaggcgggagtgcaatgacacgatctccgctcactgcaacctccccctcccgggttcatgcgagtcttctgcctcagcctcctgggtagctgggattacaggcgcaggccaccatgcccagctaatttttgtatttttagtagagacggcgtttcaccgtgttggtcaggctggtctcgaactcctgacctcgtgatccgcccacctcggcctcccaaaatgctgggattacaggcgtgagccaccgtgcccagccagcaattttttttagatggagtttcgctctcgttgaccaggctggagtgcggtggcgccatctcagctcactgcaacctccgcctcccgggttcaagcgattctcctgcctcagcctcccgaatagctgggattgcaggcatgtgccaccacacccggctaatttttgtatttttagtagagacggggtttctccatgttggtcaggctggtctcgaactcccgacctcagttgatctgcgcccccctcccctcggccttccttagtgctgggattataggcgtgagccaccctgcctggccagcatttttttaaaaagccatagcaaattcaaggaagcttttattggacttctcaatcagggattcttagaaactccgaaatcgttttttctctctgtgggcatttttcaggggaatggacatcagattttcttaacatttagggggcgaagggaaccagtgcctttctttgtgtttttctgtcttttaaaaatgctgatctggtataagaatgccccaagtcgtttccattccacatgttcctacctctgactataaacaacgtattgagggctcactatgtgccagccatgctctgcataccttatctctttgaagcctttacaactttatgaggcatatggtctttttcccatgtcatagaaagggttctctcaggttttgtaagttgtccaagtggccccaattaaaaaatgacaagatggggatacaaacccaggtctttgaaatccaaaacctatgctctactatgtcctagggacatagtgatggatagtcaagacagtccttgccctttaagattgtgagaaatggccgggtggctcacacctgtaatcccagcactttgggaggccgagtctggcagatcacctgagattaggggttcgagaccagcctgggcaacatggtgaaaccccatctctactaaaaaatacaaaaattagccgggtgtggtggctcacccctgtaatctcagctatttgggaggctgaggcagaagaatcacttgaacccaggagccagaggctgcagtgagccgagatcatgtcactgcactccaccctgggcaacagagtgagactgtctcaaaaaaaaaaaaaaaagattaatgagagaaaactagtaagctggcagtgacagcatagcagtgcttaggatggggcatgtaatccaatttgggagagttggacaatagaggtcaaagaagtgttcttgaaagagatggcttctaagttgaatttcaaaggacagcaggggttaacctactaacaagaagaaagagcagtgtgcaaagatgaaaggtagaataccactggagaactgccatatggttcactagcactggccttgctgacctggtgtgcagaatagtgaggagttattcaaaagtgtttggatcgtaatctgagggcagtagggagttacactgccttgaagtctgcaagtacgttatgaaccataagagaaagggctgagctgtcttcaaagctctcagtccatatcctgagttatttgattcaggcaggctcagaggaaaacagaaaagcctattgtaggtatcctgtaacctggacctgagcctggttttgctattcccaaaaggcctttctcccctacccctgctattcccaaaaggcttttctcccctacccccaatccaattagttttttggcgtctttggttaacggtaattgaaacaaaaagccccacagcctttttttgttttttttgagacagagtctcgttctgtcacccaggctggagtgcagtggcgtgatcccagctcactgcaacctccacctcctgggttcaagcgattctcctgcctcagcctcccaagtagctgggattacaggtgtgtgccaccatgctccactaatttttttgtatttttagtaggggattttaccatgttggccaggctggtcttgaactcctgacctcaagtgatccacctgcctcggcctcccaaagtgctgggattacaggcatgagccagcacgcctggccccccacagcgtttaatggaagtagtaagacttggtctccctaccttataggtcttgagagaataatatcatttttcacatcatttagagtttgttccatgtttgctcaaatgaatatgcattctatcaaaaactaggatgccttttgcagcttattatttgagaatgttggaacctatattgtgaagaagtggattacctctcagagattaaaaaaaatccttaaataagagtagtcagtgttaagtcatttgtggatttttttttgtgtgttttgttttttttgagatggaatctcactctgttctccaggctggagtgcagtggcgcaatcttggctcactacaacctctgcctcctgggttcaagcgattcttgtgcctcagtcacccgagtagctgggattactggcatgtgccaccaagcctggctgatttttgtctttttagtagaaacagggtttcaccgtattggtcaggctggcttgaactcctgaccttaagtgatctgcgcacctcagcctcccaaagttctcagattaccggtgtgagccactgtagctggctggtttgtgggtttttgtatctactattgaaaaacttttttttttttgaaatttttagaattggctggcaagagcagagatctgtaaaatgcaaaactaagtccattgctcaaaagctaaatgactggtttttcattatcctgttcctttcattagacttctgtcatagtacttagtaaacactccaaaggatattgaactctgaggtcagccattctaatgttttaaagaaggtttgtgatatttgtatctggaagtagacaaattattataattactgtaatagtctgcatttgtcatttttatacttaactgcagttgcacaattgcatttttaagtactagagataagtaaaacactgcataaattaggtacttctactatttaaagtagaaaatgattactttctataccttattaagaagatcttgaagactaagaaagcttgaggacctttatggcatactttaagatttttaggggccaggtggggtggctcatgcctgtaatcccagcactttgggaggccaaggcgggcggatcacgaggtcaggagatcaagaccatcctggctaacacggtgaaaccctgactctactaaaaatacaaaaaattagcccagcgcggtggcgggcgcctgtagtcccagctactcgggagggtgaggcaggagaatggcgtgaacctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggtaagttactctgctgaatcattttttaatcatgtcaccacagattggcattagaggacttgaataaaaatgcacctggcaaaagtttactttgggtagaaatgaacagaaacaaaaaaatttgaggtatttgaatatattttgaatatagaaacagtgagtgttgtgatttattttctgtttacttggccaaacaaaagtattaaaatctcatatgattcaaggcagatctttatgcaacatcagtcattatttctaattatttaaaaattgtaatgcaaaggattcgtttaagagactttccatagcagcagacatgtgtattttattttctctttccttggcttgatctatacaagctgttttaacacttaccttaatgattttttttttattttaatttttttctagagatagggtttcaccatcttgcccaggctggtctcgaactcctgagctcaagcgatctgcccacctcagtctcctaaaatgctaggattataggcatgagtcaccctgcccggccacattagtgatatttaactttcttgttatttggtctaggcagacataaataagcagttatgataggttatgtcttaagtaaaatggttacatgacaagaatccattataaagtgctgggatagttggataaatgtaaacaattaaatataatgtagcctacaactataatcatgactatagctgaatgatagaaaaatataaagaatgagcctataattaattttttttaaagacgtgggcatttggaactatagggtaagtggaaaggaaagaggcattttctttttacttttcatagcaaagaatactttttataaatgagctaaatgaggttaacaatctcactaaaaattatagcagtttttattcttattttaagaaaaaaatcttttaaagcagtaaaaaacaatcccaactagtttctaatacagtaccatgtgcatgtctctgctactaaataagtaacgagcccttcagatacaggaaaataataggaattgagatttaagtatctggctaattacaagatacctatcaaacaagttaggacatcaaaagacatttaaaatccatgtcttctgtgtgtaaacaaatctttcttgtcatagggttttatgctacctaccttcaaacatagttgaagtatcatagatctttacctttagtctagcttggtattgcatgcttgtaattaaaagcctttgactgtatgtttagttattaaatggcctttactgttatttttatgtgcctcttgaaatctttcatttcttaagttccagcatccaatttttggatgaaagaggcattttctttgcctcttaagttccagcatccaatttttttaaatgtgccatgatttctttttcagaaaattaaaaccaatacattattagtggttttaatacagaagctctgctttttgtcagtaaaaatgggttctgtcacatacgtgttttaagcatccaggtccaggcataattcagtatccatttagccaatctgaataacaatttattaggatgaaagggaagaaatcttaaagtgaattctgaaagcccttttgttgcagttcgggagtagtggaaacttaattcagtttggtggtgagaagaatgactgtctgccaaccccaattgctcagttgtctatctgtaattctctgttttttacatgggcaataaaagttgaactgactcttgtcacatagagtcagtcaaccattagaaaaaaggtatggggtagaactaggtggtgaaagctaggacttgtttgtcagtgttgtagaattttgtttttttaattgttagtaatgcatagattcagaatacaaaggctttgtttaaaaactaaaaacttccacgttatctctcctctccttcctctcacccctgccccgccccccgcccttttttttttgagacagagtctcactctgttgcccagcctggagtggaatggcaccatcttggctcacagcaacctccaactcccgggttcaagagattctcctgcctcagctgggattagagtagctaggattagaagcacacaccaccacgcctagctaatttctgtatgtttggtggagacggggtttcaccatgttggtcaggctggtctcaaactcttgaccttgtgatctccctgcctcagcctcccaaagtgctgggattacaggcatgactcaccgcgcccagcctcctcctttttaaaaaataaaacactcgtctttggcttaaaacctgttattatttaaagaaaatggtatgtcatgacatttctagcagctgaaaccacctctcccctcttttgtaagtgaaatattaggtggtaatgcaacatacatgattaacttctaccttgtcctctggcctctgagatattcctaaagaataccctatgtttcatggactgctgttagaaacaactaagctagtactatcttttatagctgcctgtgttcttatagtcttaacttctaaagagagacattatttactctgggctgttttccaataccaacaaccaactctcttgatttctgtggacaccaactgggtgtcctacaaatcaattcaattctgacactaccaggattagcatcacatcccacaagttatgggctcggtcttacaaaccgcccccacttaagacactaattgagtccagaacctctcatatttctgatgatggagtagcctacagaacttagaaaaacagttgactttcttgtgctgatgaaggatccacctcatgagcagccacatggaagcgatgcatagggcaaagtataggggaaggggcacagagctcttgtgccctctctaggaacaccaccctctctaggaacaccaccctctcagcatctcgatgtgtttgccaacctggaagttcaagagtttttatagagctgaatcttgagtcccttctccccttcccagaggttggtggttagggtaaaagtttcaacactctaatcagttgatctttctggtaaccagctgtatcctgaggctgtctagtgttcccacaccaagttacctcattaacataaactctgttgaccccgaagtctctagtgatccttccaccttagcctcccaagtagttgggactgtaggtgcacgtcaccacttctggctaatttttaaattttttgtagagacagggtcccactatgttgcccaggctagccttgaactgctggcctcaagtgatcttccagcctcaagtgatcttcccaccttgaccccccagagtgttgggattataggtgtgaactgctgtgcctggcccaaaggactcattataaataacaaaagacggtcctgtcgctcaggaaattttccaagagttttaagggctctgagccagcaactggctgcaaagcccaaatgtattttttcgttataccatatatttaatattatatttggtgatcttcacctaatcatcttcatttacctggtcttctgtcagtgggagcagccattgagaccatgtatgaaaacccattccctcattcatacagttacatagtataggaaactatcacctaaatataaatacagtggctttgatctgtaacccaaagaaaaaaataactttacatctcgatgacccagtgtgtgtgtatatatttataggtacatatgcacataaataactaaaacaagttacagaaagtaatattcttgctagggtatagtacagaatatctaatattctctatttcatttttaaaaattattgttcaggacccataaactgatttcatcactagtgggagacaccaccgttttaaaaatatttaccaattgaaattaggtttctctaaggctaatgtttcttttacctcatgtcagcttttgtttcatacataattgctgtcaaatcatctagcagtgcttccagttgatgtgcaattttcttgtctattggagatacttgtcacaagatgttcactactatttgtccattgccatgtgtgaaacctgcatctggtgcaacatgctgatgggaagagtgcctgaagtaactcccattttcccaacagtttggtagagagcgtatggacttggtgctgcatccattctagagtactcttgctccttgttggcactgttacttgtgattacaaggccctgaattcataaacttagagataaaaaacttcctcgagctttgaccttttcagttacttaatatttttcaaaattcatatcatgcacttgtactccaattttaatctctttagggaacttacatgatataattaaagacttgaaatactctcctgtgtaacagtagatcagataaggtacacagtatgttttatcttttataatcaccgctttaatagcagatgtgctattaaataggaaaagtgcccttcacgtgccattttataattgcatattataaaatgatcacacccttaactcatcctctgcaatttctcagtagtatggcacttgacaaagcacttgctctcattcttcataataaccccatgaaggctgcggggcatttttgtgttgttgctgctgtaagaaaacaggtttgattatctaactgatggaatttatatttatttaacctatttttaggaatgaccccaagttgcatatattcggaagcctgcatttaatgttttaactgtttttctattaagtttactgatttgttataggtttgcaactctcagaatattttgtttatattagcagggcattgagattgtttattctaaatgcatttttttgttttgcaatcttataggccctggcctattttgagcagttaaaaatttccccagatgcctggcaggtgtgtgcagaagctctagcccagaggacatacaggtaattaaaaacaaaatttgcatgacaatttaaatttctgtggacatgacaggactgtgaaatttacctgtatttggaaagtgttttcataaaaacattttatgacttttttttttttttgcaaagccattaacatatagtcattccatgtagaaatgagaaaagtagtaaacccagtttggccatttcagaattaacttttcagtaaaaccatcctttggtatatattgtgtacctgtcaccagatcccagctggaataaagtgcagtaaaaacttccttatcttatgattgagggtgataactgctttcctaaaactttggtaaagacggtgattgtaaatgatatatatcttaattttaaaattatttatttattttattattattattattattttcttgagatggagtctcgctttgtcgcccaggctgaagtgcagtggcgcaatctaggctcactgcaagcttcgcctcctgggttcttgccattctcctgcctcagcctcctgagtagctgggactacaggtgcccatcaccatgcccggctaatttttttgtatttctttttggtggagacagggtttcactgtgttggccaggatggtctcgatctcctgaccttgtgatccgcccgtctcggccttccaaagtgctgggattacaggcgtgagccaccgtacccggcctatatcttaatttttaattttaacttaaggtatataatcattcggtgaccaatcttttaatattggaccacagtctttatctttgtatactaactagcattcactttattcgtaggttggtcacacctgtaacccatcctctacaatttctagcatgggtctctgtacaatgagtgacgatccatagatttttaagatatttgtccccgcctctcaagtcttctggttatataggccatgtcaaatatgtacaagattttttccttctgcagtgtggctttctatgaaatctttctaaagcattcaactaactttttacggaaataggaactctcttatactcacttcattggcagattgttggtctctagaagatctttgtcagtgtttatagctggctaactgcaactctgccactcccctagaaagacagttggaagtgggtaattggtgtgttgacttttgcccccatcttgtataagcaagggtaccatatttgtaatttagtgtcctgtacgaaactttgaagttggactgacagtccatgtggccctgcttgttttggatttggctacaatagaactactggggttgaattttaagcaggacttggacgaccatctttactttcactcagactctgtctgttctgccatttgtaattttacacctaacctgttattgtaaaatgaagggactgttccaggaatcttaatatctggaatttagagggatggtttgctgcttacaaagcattgtattcaaggtgcatcttaatatcttggttagtttgcttgtcagatttaatggaaattttaaatattgtgtaatatttagagttctcatagctttttaagtaaatggattttaatgtcataaaatgagaccagtaagtatgaaacaagccaaaggtctagtttgagaaacttttctgctgtattactcattactattttgcctttgatttgttttcctcagttcatattctgcttatctcattttctttttttctttttcagtgatgatcatgtgaagtttttctgctttcaagtactggaacatcaagttaaatacaagtaaggcttttcttactgttttgactcagatttgcggggagaggtcatttttttaatttaatgtttttcttccataaggaaaccataatacaggttgtaaattcacagtgtatatgttatatccaggttatagatacgttttgatgtaccccaaagtgttttaaaagtgctgagttggccaggtgaggtggctctcgcctgtaatccgagcactttgggaggctgaggccggtagatcacttgaagtcaggagtttgagactaaccagcctggccaacatggtgaaaccccgtctctacaaaaaatacagaaactagtcagatgtggtggcatgcacctgtaatcccagctactcaggagactgaggcacgagaattgcttgaacctgggaggcggaggttgcagtgagccgggatcacaccactgcactccagactgggtgacagcgagactccgtctcaaaaataaaaaaagtgctgagtttgttggttacacataaaaatccaaggctgggcgcagtggctcatgcctatgatctcagcactttgggagtccaaggcaagaggatcgtttgagctcaggagtttgagaccagcctaggcaacatagtgagacctcatctctacaaaaatttttttaaaaaattagccaggcatgattgcgcgcttctgtattcccagctactggggaagctgaggccaggaggttgaggctccagtgagccatgatggtgccactgcacttcagcctgggcaatacagcaagaccttgtctcaaaaaaaaaaaaaaaaatgaaaatccagatatttcacagaaaaatctagatttccagcttttctggaaaagtcagaatatctggtaacaccaggcctgtttttctacatgacaattctctcttagagttaagtagctgcatgggcacttgtgttcagaatctctgacttactaattaagcaaaataacaaatcactactgagaggattcctagttcacctattggtttattctgtagatcacagaccacaaaacattttcattcgaaaaattgtgtagccatcatttgtttcaacatgaacagaatcacaaattaaagattgatattgatgccctacctgccactcttgtccttatctttaaagcaatgatgagtggcattatcagtttatgttagggaacttcagataattgagagctatacaaattttccctttcaaatatatgaggctgttattttttacaaccatagacaccaaatatagccattattctttttcttctctattttgaacagatactcagaactaaccactgttcaacaacagctaattagggagacgctcatatcatggctgcaagctcaggtaaaatcataatttcattcagtacctcaaattattagatatttaaacttattttttgcaagagtttggaactttacctcaaagattttcatcagtgttcctccatttgatttcatagcttttttaaaaggtgctggttttaaagatcatggaagtggtagtttagcaataatttaatattatatcaatgactgaaatggtcatagtttccatgacacattgtggaaactttggttttaaaatgtagttgtttttaactacttgacaaatgctgctttctgtttggctcttaaaggtgagccctcctggacagcctctccaccagagccctttataaagggccagttgagttcttttcagttaattttagctaatcttaacacataaagcagttgtgtagctagagttttcattttccttaaagagcaagtagaggaaaatttttttttcttcttagaagaaattataggaactattaaaactctgcacatgaaacttttctgtcaaagtgtaagaatgaggaataatcattacagcctttaatggttcatttaattgttcttcatctggtcaatcacttaaatacttttgataattttgataatcataattatcaaaataattttgaagagtatttgttgcatagtttatctgggccatgttgacatttgatgaaactttgccttttaataagacaactggtgtttctgggtcttttcaatttacatttaattttatggactgtttctctgtttgtcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggcaagtaactaaccatgaattttttatatttaatgtaagttttgtaggtgataatgggcacataataaaaagagcagggaagttttctttcttgaggtaaactttcttaagttatataattataaatttacctgatgttttggattttattttatgaaggaactcaaacttggttattttttttccagaggtatattgaaattaaagtattacattacattttttatttttttacttttttgagacggagtcttgctctgttccccaggctggagtgcagtggcacagtcttggctcactgcaacctccgcctcctgggttcaagcgattctcccacctcagcctccctagtagctgggattataggcacatgccaccacgcctggctaatttttgtattttttgtagagattgggtttcgccaggctgtgctcaaactcctgacttcaggtgatccgcccgccttgccctcccaaagtgtggggattacaggcatgagccactgcgcccagcctaaattttttttaactaggcaaatactgtagtgacatacacgagttgattttcttttatgaatctgttgagaaaggtagtctcaatttaatactgctatatagtccctgagcaaggaagaagcattgcttaggagttgtccgtgttgctacttctgtattcttcatcacatagtgtaagtactatgttactatattgagaaataacttaaaatatgcttaagatttctaagcagtgctttttatagtttgtatttactaagaaattaactctgacactgaggagtagaacagaaagaggaaatacaaagaatcacaggatatgatcttagagctggtaaataggaaatactggtagggaatgtgttaacaagtctgaaagtttactctctgcaagtatattcagatatcaaacatgattttgtaaggtaatctactttgcatttggcgttttgtattttaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtaagtatgcctattatttttatagtataaacttgtaaaatacagtatctaaaactcatgactttgaaaatgttacaattttattgtcccattaccaggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggttggtaaatttatataaaacattgtatgtaaagttgttagaacaaactgggataggtactaagttaaatataataatagctttttttcttctaaatgttataaactccccttgagattataatataaaccactgcatctagccaaaatgttctcagtagcattctccttggagaatgggttataccagttcttaaacctgaaagcctgtaattgcacatttctcacaaactcttaggagatgctgacacaacttgttcatagtggaattgagattttttgttttgttttgttttttgagatggagtctcactctgttgcccaggctggagtgcagtggcacagtctcggctcactgcaacctccgtctcccgggttcaagtgattctcctgtctcagccttccgagtagctgagattacaggcgcatgccactacacccggcaaattttttacctttttggtagagacggggtttcaccatgttggccaggcttgtctcgaactcttgacctcaggtaatccacccacttcggccttccagagtgctgggattacaggcataagccaccgtgcccagcctggaattgttaaatatatgacgtcattttaaaattgaatcctgtaattagcacttgattcatattaaagttcagtttttcctcttagcttgggcaggcagttttaaacagagatgtgtcttgattgcttataggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacaggtaagtttttgttttattctttttgctcaatacataatacaaaggagccatggagaagtggaaaatatggaaaaattaaaaatgagaaaatacccataattctactacctaaagatatttactgttaaatactaatgtatttccatcttaaaaaaaaaagaattggccagaaaatagtttcaggttctaaattcagtagactaaccagcttcagaggtagttataggtttaggtttttttttttattttgaacctgtctttatttgtgaatacagttgaaattttcataagcatggtttgttattttaatttacatatacatcattcatttctcataaacaatttttttttcttttttgagacggagttttgctgttgttgcccaggctggagtgcaatggcgtgatgtcagctcaccacaacctccacctcccaggttcaagcgattttcctgcctcaacctcccaagtacctgggattacaggcatgcaccaccacatccagctgattttgtacttttagtagacagggtttctccatgttggtcaggctggtcttgaactccctacctcaggtgatctgcccaccacagcctcccaaagtgctgggattacaggtgtgagccaccacgcccggcaacaattttttacaattaaagtttcccccacttccagaaagaacttgtaggtggtgttagtctccatattatagcatttagcaattaaaataattagtaacttatcaatatgatattagatgaaagccatttctgtatatttactttgaattaattgagtcaagtcaaacttaaaatatgttcccaaatgactttagtttctgttttattgtagtaaacataacatgtatctttatgtatacttcaagaaattttatgcagtgtggaaaggtatgatcactattggtaattccattgtatatctcttaatggttttgtaggcttgttttgctttgtttaaaaacctttgcagaatatgttataggtgtctttgtctacatgtcaagttacttactagaagtggcattacttgatcttaggttaggtatattttaaatataggcagctgctgctaaactgccctccaaaaaagttgtgtgcatgttttcaaagatcttgattgattacaggccaggcataatggctgtcacctgtaatcccagcacttggtaaggctgaggcgggaggattgtttgaggccaggagtttgagaccagcctgggcaacataggaagactccatttctataaataataaaaagaaaactagccaagtgtggtggcacatgcctgcggtcccagctaacttgggagggtgaggtgggaggatctcttgagccagggagttgggggttgcagtgagccatgactgcgccactgcactccagcctgggcaacagagcaagaccttgtctcaaaaaaaaaaaaaaaaaccaggtcttaattgattcgaaaaatgttctgatatgcaggtataactttagaaaacctaataagttattgcttcctttttaacagcttacagtgctctcggatcagcaaaaagctaatgtagaggtaattgactttatgcttcttttaaaccaatgatagatttttagtctgtaatttgccttgaaatgtagcttaatttcaaattatatcaaattagaaggagactgacaaaaactcttttattctcaattttattcttaggcaatcatgttggccgttatgaaaaaattgacttacgatgaagaatataactttgaaaatgaggtaagaatttttttttgttgaggagaaaggagttttaattttattattatatcaaattaatatttcaagttcttattgtttcggggccctttaaaacatgaagttcttgaaaaattagtctgtttatattgacaccaaccttgggtgaaattaatagaagcctcttaatccttcctttttgatattttatccattaacaaccaccccccctcctttttttttgctttgagacagagtctcactctgtcacccaggctggagtgcagtggtgccatctcagctcactgcatcctctgcctcctgggttcaagtgattcttgtgcctcagccaccttagtagctgggattacaggcatgtgccaccatgcccggctaattcttgtatttttagtagagacggggtttcgccgtgttggccaagttggtcttgaactcctggcctcaagtgatctgcctgcctcagcctcccaaagtgttgggattataggtgtgagccactgcacctgtcccattaacagcccttttacaaatactgtgtagcactgaacatagtaaaatattgataatattattggtgatcatatttcactttatattttgtaagaatgatgaactccagtcacaagactgtattggcagagtggaaatgaggcgctctagacttgttccagttaaaggtctttttcaagattgtgagtgggtcagcttcccatcaaacaagggccattggtgctttctaggtattcagtcatggtatttgctgctaagctttgttctaaagtgttgtattcccccacctcagacattcaaaaacttagggttgtaaaaggataatagtggtgctgaccaacacactgcgcacctgggatgtgccaggctcctaagattgaatatctccagttataccatattattaccactttttacagtggatattgacttacaagaataaataaggtgcaaagaattcaaagcccattctagtgctagagtattgtctttaaccttcttagactatttctagctctaggcttttgaggtctacggctttgtgcagaaatacttatttgtgagctggagggaagaagttattaagcttaataagtttttctatataaatagtgacaaaaataaaagtacgaaatatgtaaatgcggaaaaatacaggagaactggatatttacatgaattttaaggtcttttaagtttttaatttttattattatactttaagttttggggtacatgtgcagaacgtgcaggtttgttacataggtatacatgtagccatggtggtttgctgcgccgatcaacccataagttttttgaatgaggattttaacctgtatcatagggtgaagatgaagccatgtttgtagaatatagaaaacaactgaagttactgttggacaggcttgctcaagtttcaccagagttactactggcctctgttcgcagagtttttagttctacactgcagtaagtttgtcattacttttgtaacaagcctacttctttcttttgctctttgatatgggtcaaaataaatgattcatatgacttattaatccatgttacttattgagatcttatgtgtatctctggaaacaatgcacttgtcttcttgatttatcttgatcctttctacctttgtgatgtattgcctgggaaagttaacagttgctatgactttttaataattaaaaaggcttttgttggtgtcttaccctgtgcataatttgctgtatgaaaaatttatctttaaatctcactgacatattataccttggtaggaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactgtaagtatactggagataattttgaccataaatttctgttttcagtataagctaatgggagttccttaattgttagagcttagtatatgttaataccggggcattttgatgttgcaataaataagaagaggtttcctaactttttcctgatctagctggtaacatcaggagtcagttcctatcagcatacatctgtgacattggagttcttcgaaactgttgttagatatgaaaagtttttcacagttgaacctcagcacattccatgtgtactagtaagtactctggatttttgttactttccatgggtttcagctaatgacttgatagtgtagtattgtatttttctgtctataacttttctcagaatcaaaacctctcagaagtgcttggcacacactgaaagtaacccctcctccatttcttttaaatggatagtttgtgcccaattagtcaactaaaacaagttctcaagggactgtttgtgtgtagtttagaattactcgtatattcctagtccctgccttttaggagctaagaagtaaaatttggtgtgaacaaaaatgtagcaggacaatatcaacaaaacccttgaaaaaatgcagaaatagtaaaagtgtctccttctttagatggctttcttagatcacagaggtctgcggcattccagtgcaaaagttcggagcaggacggcttacctgttttctagatttgtcaaatctctcaagtaagtataaaattgcagctattatgtttagttattttttaagttactggatagatgtaaaacaatagtaaagacatggaatcaacctaggtgcccatcagtggtggattagataaagaaaatgtaggccaggtatggtggctcatgcctataatcccaacactctgggaggccgatcacaaggtcaggagttggagaccagcctggccaacatggtgaaaccccatctctactaaagatacaaaaaattagctaggcatggtggcgggttcctgtaatcccacctactcaggaggctgaggcaggagaatcgcttgaacctgggaggtggaggttgcagtgagccaagatcacactccagcctgggtgacagcgtgagactcagtctcaaaaaaaaaaaaaaagaaaaagaaaatgtagtacacatacatcatgaaatactaaacagccataacaaagaacaaaatcatgtcctttacagcaacatggatgcagctggaggcctttaatctaagcaaattaacgcagaaacaaaaaaacaaatgccacatgttctcacttataagtgagagctaaatcttgggtacacacagatatgaagctgggaacaaaagacacttgggactccaaaatgagggagtggggcaagtgctgaaaaacttcctgttgggtactgtgttcaatatctgggcaatgggattggatcaatagaagcgcaaacctcagcatcccgtgatatacccgtgtaacaaacctccatgtgtaccccctgaatttaaaatgaagatggaggcctggcgcggtggcccacgcctgtaatcccagcactttgggaggctgaggcgggtggatcacctaagatcaggagtttgagactagcctggccaacatgatgaaacccggtctctactaaaaatacagaaaattagccgggcatggtggtgggcacctgtaatcccagctaacagaaggctgaggcaggagaatcacttgaacccaggaagcagaatttgcagtgagcagagatcgtgccattgcactccagcctgggtgacaagagtgaaactctgtctcaaaaaaataaaatgaagatggaaataaaaaaaaagtagacatataaattattttccaagagcctatggtagatttggttcttcctgttcaagtcaagtcatgctttgtcaggtcaggtagatgtactcccgacctttttttttttttttttttgagacagattttcgttcttgttgcccaggctggagtacaatggcatgatcttgactcactgcaacccctgcctcctgggttgaagcgattctcctgcctcagcctactgagtagccaggattacaggtgtccatcgccacacccggctaattttttgtatttttagtagagatggggcttcaccatgttggtcaggctggccttgaactcctgacctgagatgatccaccctcttcagcctcccaaagtgctggtattacaggcatgagccaccgcgcccagccccctttttatgttgccacttcctttcctgctcatcagccaagtacttagttcaatagtaaaagttttcattgttttttgttgttatttttttgagatgggggtctcatgctgtcgcctaggctggagtatagtggctggatcccagttcactgcaacctcaacctcctcaggctcaggtgatcttcccacctcagccccctgagcacctgggactacaggcgtgtgacgatggccggctaatttttgtattttttgtagaatcagtctcaccacattgcccagcctggtctcaaattctttagctcagtcttcccacctcggcctcccaacgtgttgggattacagaaatgagccactgcacttggcctgtattattctttactagtactattttttgcgaatgaaaactactccttattaggtttataagattgtaagtcattttgacaatcttatcactacagagcagataaaggtaatttttaaaaattaaccatagctaatcttaatcagaagtgactagcctacaactgaacttttttttagttctgtcttaaagggggaatttggtattttagcactgttttgagcactgttattaattgtgatttcctttttctgtttttcagtaagcaaatgaatcctttcattgaggatattttgaatagaatacaagatttattagagctttctccacctgtaagtatctgtctctttaagatattttacccagaattcattgaagccacacgtgccattagccttgcctttgttggcatttaaaaaaaaaaattggtggtggagggaagtgtatgtgcaaagattagttctatttaccaaaattctgttgacatagtaaacaaaacatagtaataggaatcaagagttgacagatcaatttggcagcatggggtatattgttaaaatgttgaagcattttatgaagaagaaaaaattcattaaagatgagcttgctgttaaaatgaaaagtatattaaaaattttaaaaaccaaaagaaaataaaaatttaaaaaattcaacttctaaattattctgtttaatcctataattgtattagccattcttagcagctgctactgttagatcgaaggttttccctgtcatttcaggcttagggtaaaaaaaaaaattaagtgctagtcgatctgaatattttggtgttgggattgggccataatcccaagtgttaaaatcctgaaatcctaaaaaccacaattctaaaagatcaaaatcttaaaaatataatcctggaaaaagtaattttaaaaaattatttgaaagatattactttacatttttaaaagggaatgtatttgagaaacatgtaaaaacatgacagcacttcataggccactttacacaataaaataggcaataataacatgcttttgcaagcataaacagttataaaaatgacagttacatgtgtaaaacaggagcagacaaactgtattcataaatcagaaagcaaaatgtgtaagtgcatgtcactatggttagtagttgtgtgccactctgctttataactgcgctcatctgaaataaccatgacagacaacctaagtcttgaggaaattgataaaaaacggcaatgggtcactacaacatatgcagtcacccaaagaactgagatcacaagaaattttatgtttcacagatgcagatgtacagaaaggacctttcttgtgtacatgcagtgtttacacacacagttaatgctgtgtgtaatgtacttttgcagagtcaaatttctgatgttcaaggccgcagaagaaaagtctgtccacctttcagagagagaccaatttgccttatgtatttgttctctcagagcccctggtcaattggatggtgcccgccaacactgagggcaggtcttccccacatagtctacttggactgactaatctttcctggaaacacccttacagacacatgcaaaataatgctttactgtgtgttgttacttaattatttaaaagaagtatagcactctagtacttttttttttttttttgagacagagtcttggctctgtcacccaggctggagtgcagtggcatggtcttgactcactacaactctacctctcaggttcaagcagttctcctgcctcagcctcccgcgtagctgggactacaggtgcgccaccacacccagctaatttttgtatttttagtagagacagggtttcaccacgttgaccaggctggtcacgaactcctgacctcaagtgatctgccggcctcggcctcccaaagtgctaggattacaggcatgaaccaccacatgcagcctagcctcataacaatcttatataaataagatctttacaaaagaaaacaagttagaaagctaactttaataattatcttacatgatcatttatagagtcttgtcagggctggaattagaaccgtgatctgttgacctctaatttagttttcttttcattctatggtcctgggagaaaatttgtctttataagtatttgacatatgagttggtgtgatagattacatttcctgttcctaatgcactttttctcattaaatgaagggaactcaaaaaataaaagctttaataagactgaatttcattctaggagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaaggtaagtgtgatcacagttaaaattataaagtgcatgtatctacacagacagaaccacttgtttggtgggcacacacatttgtgtttccacagttggataatccagagaattgtctaaatctttgtcctccaaatccagtcagttagatttggttgaagaaggggataggttacataccatttacatttttgccttgacaactgtaaatctttaactcctctgacttctctgatataaatgggttgtgtgtttaagaggatcagctgaagtgttaatataccaaatatatattgggacgggacatctttggttagtcttggttaccttaaagagaagagcgtgaggtttctcttcagttgtattgtgtcctgaagatcacccaagcagctgttttttccgcctctagccatactttttgttgacaaacaacagcatgaaagttgtaaagattgctaatttagaagttaaattgttctataatatatttaagaacaagagctagatattagagaggttgtataaagaattctgaagatggttttctaaatttaaatgggtggtttgcaggttacctagtacaggcctagtcataataagtggatttattttctcttttctgtccactttgtcagtaggatttttctcttttttttcttttttcttttttttgtgggggagacacagtcttgctttgtcactcaggctggagtgcagtgttgtgatctcagctcagtgcaacctccgcctcccaggctcaagcaattcttgtgcctcagcctccaagtagctgggattgcaggcatgtgctaccacacccagctaatttttctatttttagtaaagaccggttttgaccatgttgtccagactggtcttgaactcctggcctcaagtgatttgcctgccttagcctcccaaagtgctggaattagaagcatgagccacaatacccagcccagtcaataggattttaataaaacatttaggtagactcacattagaaggattatattaactacatgtcattcatttaagttaatttgagctcttttgttctggaaagatcattggaagcagtagtttacaaatagccatattagctaaagatggaagtaattgtgatgtggaaaataaaggtctggttatttagttttgttaattttgtaatttgttgtgcattgcttttgaatactccataacacttttaaagaataaagttgcatctgattgcctgatttttgcttatatagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaaggtaccgcaaactttcagagctctgaaaatctcttgaagatcagatgtatttatcttcagacatgtttcggattttgcccttgggtttctttttttttgcttttaatgaattacttaagagcctcatggatcatatgtatttttatcatctgtggtgtctggcacactgcctgatacataggtcatgcttaatagatgtttgaatataaacagaccctaaccgctttgtgtagcaaaagaaaactagtctgctgttttagaagagcatataaaaccagtaaactgagtactaaataagcaccataattcaggtacccaagcaagagttaaaagtaattcaatgtattaaagtcagttttctgtaggacatttaagctggctaataaaagtggttaatacttacatagtacctcttttttccttttttcttttttttttaaatggagatagtctcactctgtcacataggctggagtgcagtggcgcggtcacaactcactgcaacctccacctcccaggttcaagcgattcttgtgcctcagcctcctgagtagctggaactataggtgcatgcaccacaccacgctaatattttgtacttttagtagagacagcgtttccccatgttgaccaggctaatctcgaactcctgacctcaagtgatcctcctgcctcggcctccataagtgctaggattacaggcataaacctggccacttacatagtactttctatgttcaaaatctgttctaagcattttttgtacatttactcatttgatcttcatacctaccctagaagacagggattatatgttatagttgaggaaactgaggcatggagaagtgaagggatttgcccaagagttcataaaactcaggagttcatttgtaagcaagtattgagaacatgctattaaacaatgttttttacctttgttcaaaaacaagaaaaaccctaagagtttaatcatataattcattttttgagaatttaattttgaaaatattccatggcaatattgtgaaatatgtctgactattattttaacctaaatcttaagctgtaggaaagggtttaaatttaatgatcttgagtcttttagtaatattttttaaggttttttccccaccttgaaatggagtcttgctgtgttgcccaggctggagtgcagtggtatgatcttgactcactgcaacctccacctctcaggttcaagcagttcccctgcgtcagcctcctgagtagcttggactgggactacaggcgtgcgccactacacccagctaatttttgtatttttagtagagatggggtttcaccatgttgggcagactggccttgaactcctgacctcaggtgactcacccgccttagcctcccaaagtgctgggattacaggtgtgagccactgcgtctggcctagtaatgtttaggttatatagattttatcttaaaattgatatttgctaactgaattatgtacgcatgcatcctaaatagaaaagaaaggctttatgtaaaatagttttttctaagttgtatgttaatattgttactaatttctgaagtaatgattgtttatcttcagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgggaacacatgccatatctaatttgtctgcttaagtctgtgtcactgttgtacatctatatgaccaagagcaaactgaagtaaatacagaaattttgaagtttgctatcccatgggaagacagtttattgttttcagggtgggaattgatcacttttatgtaaagcacctaaaattaatttgtattctgttcctttttctttctgcaatatttttttaatttggttctttagcaatataaataacatggttacttaccagaattgacctgacaattgagtctttatggcaaatttgccattttgaaatataaaataaatggagctgtacagatttgtgtagagaattctgtataggaaatttagggaacaagataccaggggcaaactgatttttcattgttttattttttaatttgatttgatttgtgagatagggtctcactctcttgcccaggctgtagtgcagtggtgtcatcacgactcattgcaacctccacctcctgggctatcctcccatctctacctcctgagtagccaggaccattggcagttgccacaatgctgggcttattttttgtagagatgggatctcaccacgttgcccaggctggttaaactcctgggctcaagcaatcttcctcggccttacaaagggctggaattacagacaggagccaccgcgcccagctgatttttcagtgtttaatgtttaaactttaggtgcccagttaataaaaatcaagggattttggcaattctgtaaatgcttttttcccccttcatttttcccattccacctgtaaatgatttttgacttgttaatgtatatgaaaagagaacttcaggttgctttcctagttaattttggaaattgcttaaactaaaggtttttctcctcaggtgcagagaatgtagaaagagtgttggttactgttatccaaggagcagttgaatatccagatccaattgcacagaaaacatgttttatcatcctctcaaagttggtagaactctggggtaagataattttatttcttaaccttcatttcccaaactctttcataaaactcttagacataatggaacatagccctaacagagagagaaactgggagttggttttccctggtgatgaattaattgacttacttttatatataagatgaaaatttgaattctcttgacaggaggtaaagatggaccagtgggatttgctgattttgtttataagcacattgtccccgcatgtttcctagcacctttaaaacaaacctttgacctggcagatgcacaaacagtattggtaagcacctaggaatctttgtttaccttgtgtagctcatatattcccaatttcttctttaatgccaggttgattatattatgtttcattgattttttttttaacttagtgatttcagatcagggttctttttttaaagatttatgataccttctggagtttttatgaattcttattgaatcccaatgctactgctgaattttacaaattctactccttcgactttaacacctgactttttctaggaccatgaaagggcatatgtcacaaacattctttcaagcttgagtattagtttcctactactactttaattctaaaacttgtacctagtggttttccctaatcattaagagcatgaaatggcaacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaatctggggtcactgcagcctccacctcctggagtctcaactgatcctcccatctcaatctccagagtagctgggaccacacagatgcatgctaccacacctggctaatttttatattttttgtagagatgggatttcaccatgttggccaggctggtattgaactcctgacctcaagttgatctgcccacgatggcatccaaaagtgctgagataataggcgtgagccactgtgcccggccttggttatttttttaatatatattttactttattttttgtggtaggttctccctgtgttacccaggctggagtgcagtggcatgatctcagctcattgcagaccccacctcccaggctcaagtactcttcccacttcagcctcctgaatagctgggagtacaggcgcacgccaccacacctggctaatttttgtggtttttatagagaccaggtctcaccattgtccctacactggtcttgaactcctgggctcaaacattcctcctgccttggcttcccaaaatgctggtattacaccatgcccagctgattctgggtatttgtaaataactggaattggttgccaacatttaaaaatctcaaatacttttttttaaccaaaaattcttccctccagcctctctcaaagccatagaatgccagcacaggactgttattgccacatagctacagccagctaaagagcagtagttgccctcaccccctaaaaagaacatgagcttttgctcagtggtctccattcagctgtgcactcatttgaacttgattttttgattctgatagagacttgaagtgttttcaattcagcagcatttcttctatacttgctacctgctagggtggggtaggtgtgtgtttagggacagcaggggaactgtataaaggtaaataaggcatcccccgatactcgagaactcagaatcaagggagaccaacacataaaaaactccagtgggttaagtactttagtggagatacataaaatattgtggaactaaagctgaatgggcaattttgcctgaggggcaatctaagcaagctataggaaagaggtgatatttttgatggcccttaaatgtagattgatgggagtaatagggagctggcattctgggcaaagttaagtaggtgtacaaagacagattagattagatgtcacatggtggatttggtgggaagttatagacttaattctgtttagctaaagtatagaggcagaagtgatagctaaaaaataagatgagactagataaaagccttgtgttacatgtgtaaagtcaggaagtcagtaggcagtgggtttgtaatttaggagggaaagtgttcggaacaatgggtctgaagcagttaggattaaatactgattttggagtcctcagtgtaagtcagtcaaagtaaagccataggaatgactgagactttctaagaccagaacagaaagaactttggctcaagcaagagtcaacagaaaggtagaagtagaaccagatagtcaggtgtggtggtgcacgcctgtaatcccaactacttggcaggctgaggcacaagaattgcttgaacccaggaagtgaggttgcagtgagctgagatcgtggcactgcactccagcctgggcaacagagcgagactctgtctcaaaaaacaaaaacaaaacaaaatgaaaaagcagaaccagaggtaggagcattatgaaagataagagaagacagtctcaagagaggagattggatggcgttgtttggatgctaaacagtcaaggtggatgtggatgaaggatgaaaggaaacagtaaggatggtatttctacttcagaagtatttgttttatccatagaagtcgtaatttaaacatacagaattgagtcaaacaatattttaaagtgttttgcttcagaaaacaaaaaaaagttttgcttcattgttcttttttctcatcttttgactgacttgaggtataagtttactttccctgattcaaaacaaacaaaactacactcttttaaagtgataacagtgaggttacaaagtgatgaacattgcataggaagcaagtacagacagggtagacataagaaaaagatgagaaggaaagtaggagggatctgggaaacagtgaagggttactgcctctcagttacagacaggtttcctctgatgggtcattaaactgggacttagatccaaggtgaaggaggaaacataaatcctttgattcagaagcactaatattaaacaggaattccaggtggtagtgcaaggaagagtacatcgaggagagatacattgatttttttttttttttttgagacagagtctcgctctgtcacccaggctggagtgcactggcataatctcggctcactgcagcctgcgcctgccagtttcaagtgattctcctacctcagcctcccgagtagctgggattacaggcatgcgccatgatgcccagctaatttttttgtatttttggtagaaacagggtttcaccatgttggccacactggtctcgaactcttgacctcaagtgatcacccatctcctcctcccaaagtgctgggattacaggcatgagccactgcacccggccaagaaccttatttttcagatggagaaactgaggcttagagaggttaagtaacttgcccaagtgcagcaaaccaccagggcacatgtatacctatgtaacaaaactgcatgttctgcacatgtaacccagaacttaaagtataattttaaagaaggtgccagagccaggcttcaaaccaaggcagtctggctctcgggtctgtgttcttaagcacaatactatattgcctttaaagtgtacatgtattgttccgattctttttaagcttattaatgtcaagcaagaaaatagttgtaagtatcttttaatcttcagggcccagaatgtgttcagtatcttcaacaagaatacctgccctccttgcaagtagctccagaaataattcaggtaagagctatttcttaccattgtgtaggcgagagatcacagtagtagcagcattgcctgtgacattgtcgctagcagaaatcaaaaatattttcatattacataagttgttgccagcatctcaaaatactgtttatgcttatcaccattttgaaattatgagttactaagtaatatcactacaccttgttacccaacaagttaataagtccttactgttctagcatactttagtttgataaccattattcagtataattggcttctatcgtaatcccatgtattatgttttatgcatttttttaaaaaaacattctaaaggagcctaataggcttttccagactgctgaaggggaccacagcagagttctgaagctttgtaccaggtagttcattgtgtgtacaccaagcttatcaatgcttaatctgtaaatctgaaactattttaaggaaagtgtctggaaagttaccttatacttttaagaagtcatttgtataatattgtttcttggcatataattttccagatttcttgtccagtagtacatggagttaatgaagtatcaaacttgattaaaactagaattacaatctcttatgtagattccaaaatttgtttcttcatcaatagtgtttttattttattgtaagaacacttacatgagatatataccatcttaacaatttttacgtgcacaacacagtattattaattatagggacagtgatgtgcctataaaatataggtggatctccagaacatattcatcttgcataactaagactttatacccactgattagcaattcccatttcccacagcccccatctcctagaaactaccattctactctctgattctgtgaatttgactactttagatacctaatataagtggaatcatgcagttatctctctttttgtgactggctgtttcacacaatgtcctttaggttcatccatgttgttacatatggcaggatttcgcaattttttaaggctgaataacatgccactgtatgtatatatcacattttctttatgcattaatccactgatagattcattggggctattttcacattgtaagtgctacagttaacatgggaatgctaatatgtctttgagatgctgattccaattcttttagataaatacccagaagtgggattgctggattatatggtagtcctatttttaattttttgaagaaacatcttactattttctatagtggctatacaccattttgcatttccatcagttgtgtagcagggttccagtttttccacaatgtcaccaacacttgctgtctttcatttttttgtaatagccattctaacaggtgtgaggtgatatctcattgtggttttgatttgcatttcccttatgattagtgatgtttgttttttcatacacctgttaaccatttgtatttggagaagtctattcaagtctttaccccattttctaatcaagttattaagttttttgctattgaattagaggagtttttttatatgttagaaattaaccccttatcagataaatggtttgcaaatattttctcccattctttagctattccagaggttgcctttctgctctgttgattgcttactttatggtgcagaagcttcttaattcaatgtagccccactaatgtagcttttcgtgatatcaatgaaatcatttcaaagaccagcatcttgaagcttttctcctatgttttcttctagttttgcagtttggagacttacatataaagtctttaatacattgagttgatttttgtgtaagataagggtctcgttttcttttgcacgtagatatccagttttaccagcaccattattggagagattattgttccccattgtgtattcttagtacccttgttgaagatcagttgactgtatacaggagttgattttcaaattctattttgttccattggtttatatgtctgtcttaaaagagagagggtctcactctgttgtccagactcaagtgcagtggcaccatcatagttcacagcaactacaaacgcctggactcaaagaatccttctgcctctgcctcccaagtagctaggatatatgtctgtcttttgctagtaccatactgttttcacactgtaatattaaaatatattttgaaatctggaagtgtggtacatccagctttgctctttctctggattgttttggctattcagggccttttgtgattccatgtaaattctagttttgttttttctatttctataaaatatgctcttggaactcttatacggattgccttgaatctgtacgtcactttgttttttatttttggaatgattaagaagctttttaaaattttttaaatttatttttattttttttgagatggagtctcgctttagtgcccaggctggagtgcagaggcacgatcttggctcattgcatgcaacctccgcctcccaggttcaagtgattctggtggctcagcttcctgagtagctgggattacaggcaggcaccaccatgcctagctaatttttgtttttgcttttttttttagtagagaccaggctggtctcaaactcctaacctcagtgatcttcccaccttggcctcctaaagtcccaggattacgggcgtgagccaccttgcctggccattaagaagcattttgttgacctgatggaacagggatattcatttagcagctcagttttatatactctttcccctgtgtcattttacataatgtgtaaagtgggggggggacccttttattgcaaagacatttccagagtcgtcatctttttctttctttttgagacagtcttgctctgtcacccaggctggagtgcaatggcacaatctctgctcactgtaacctccacctcccgggttcaagcaattctccgggttcaagcagttctccggcctcagcctcccaagtagttaggattacaggtgcccaccaccatgcctaatttttgtatttttagtagagacggggtcaccacattggccaggctggtcttgaactcctgacctcaagttatccactggcctcggcctcccaaagtgctgggattacaggcgtgagccaccacacctgtccagaaccaggggcttttctgtgaccaaggtaaccccatatcaattaccctagcccatagtgtccttggaccttactgctaggcactggctttcagtgttgctttgtacttccctgtcgtctcctaatgccattaggcctggatagggcacctgccctttaacttcacaggtagattcccatcagaactactttgaaggccaaaatgagctgggtgagagagctgctttttctcctgctctcctttcttgtgtcctcattcttccccacgatttttttgatgtgttccataatctccttattcatcttgatttctatatccaccaggacctgctcttcataatataaatagaattgtaggaagggtaatggtattgtgttcttaaacatcatgatctgcatccaagggttttttgtttgtttgagatggagtcttgctctagtcttgctctgtcacccaggctagagtgcagtggcgcgatctcggctcattgcaacctctgcctcccgggttcaagcgattctcctgcctcagcctcccgagtagctgggattacaggcacccgccactgcacctagctaatttttgtatttttagtagagacagggtttcaccatcttggccaggctagtcttgaactcctgacctcgtgatccacccacctcggcttcccaaagtgctgggattacaggcgtgagccaccgtgcccgatccaagggttttttttgtttttggatttgaggtatgttgaaaaatacaaatttcctgccactgtcacccagctccccatgtgtgttataattcactcttatgaccttcaccaagtccctgaacactactacatcaccctggtctgggtattgcagaagggtaagggccccttcataggtggtggcagtcaaacaccaaagagaggtaagagaacagcagacatcacttctcggcagattgctttgggtagcaaagacattttaacaatattaagtcttcagtccatgaacacagctttcaatggtgtttttttgttttttatttttattttgagacagggtcatccactgtcgcccaggctagtgtgcagtggtgcgatcttggctcaccgcaacctctgcctcccgggtttaagcaattcttccacctcaacctcccaagtagctgggactacaggcgcatgccaccacacctggctagtttttgtatttttggcagagatggggttccaccatgttggctaggctggtcttgaactccagacctcaagtgatccggccactttgacctcccaaagtgctgggattacaggcatgagccactgtgcccagcctcaatggtgtttttttgaagtttttataatgctgtttttttcaaaaataaagatttcacatgagtttaaaaaatgaatttaactcatttttaatgaatttgtgatctcttatttcacagtataccacctttagagatattaatgactttcttggttatcatttgatatgtaaataaactcatattttaatgaaaataataaattactattcttgtgatcttagtgctcatcaaaagtagaacttagaccattcagtttacagctaatcttccagattgctaaatgaaataaaattatttttctatttagtaattcattatgaaagataaggaacctcagttttccctttttcatatgccttatgtctgacaacacattttgcacaatattctctattagaattttcttttcttttggtctagctctgtttggttatccctcttactagatgtgagcagccgtagcaatgtagtttttgtcccattcactcctctcaggcatgaatccaccttgtctaggagagctatgttctcaaaagtgaaagcagcctgtttgacaagtactgacatttgaaaatgctataaacctcttgtggtgagatactgtttgaattaatcttgataagttaaataccatgaatttgaagcaaccttaaattcctttgacagataaatggataaacaaaatatggtatatacatacaatagaatattaagcctgatttataaaataatcctgtcatatgctataatgtggatgaacctagaggacattatgctaaatgaaataaggcagttattaaaagacaatgctctatgattccatttgtttgagatatctaaagtagactcaccaaagcagaaagtggtggttgccaggggctggagtaggggaaaatggggagttcttcagttaagaggcaaaaagcaagcttgttttgcaagatgcaaaagttctagaaacctgttgtacaacagtgtgcatgtagttaatgcttactgtactgtacatgtaaaagtggttaaggtgataagttttaagtgtttttaactacagcttttttaaaaaaagagctgggcacagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggctaaaaatataaaaacagaaggatgagatatttgcttatatcctattttgaaacatttgaactgtaaaacagacaaaaaggagaatcctcagatttgggccatcaagcctccttttacatttacgaaattactgatttttttttttaactctgtaaatcaacaaaaagtgtcacgtgtttatttggtattcatagttataattgagttcatgagatgaaactgtcttggtcttacctaggtagtcattcatttcatacataatgactgctttttatgtaccaagtactacagtaatggctgcaaatacaactatgagtaattttccctccccataaggagctcatgatctagaaataaagttacagtgtgacaaggtgaattattttttattatcttcactcaaataatttgaagacaaagcactgtattaaattcagtagcaggtaacttagtgtatcacctggttcttttagcaaagacattcagtagaatttgtaagtcagagggctttgcgcagtaaataatttaagtgtgccatcctttgactgtggttctaacatcttcccttgtcagttttttcttagttgtagtttgtcagcttaaacatctcagagtttttgtggaagaatattgagggcttgtttttgtttatcattgggaaccctccccttcgccatcctcccataaaaaagcaaagtgcctacaggagtaacccctgttaaataactgatcagtcaaactgaatttaaggactcagtcctcactatctgttagaggtgtctgtaacagtagatctaggtaccctatagaaggcttgttctccagatgtggttatttatctgcatagcatttataaaaagtcttccttctgggcccaacttctcttcagtgatgacattatcttagtgatcataattctcagtgttagcattattattctagttggaaaaaatgaatttcattcgtgttcactcctcccttcacatctgattgatcctcagatcttgcagattctttcctcatcttctctctcttctgtctctgctgctctggtgtaggctgatgttatcttactctgatctctcttctcttgttctagccaggctgatgtgtttgaaaacttcaagcagtcctttgatatttattcaccttcctcataaccttcctgaacaaattcatgtttctcagtttggcacttaattttttttttttttcatattctgccctgagactacctttctgttttttcttgcagaaatggtctttactgttcttgtagttcttcaaaaatcctgccttactagcagcccaacttctgtatgaactgtacccatttctctaggtttgccttaagcacagcctccttgtaaggttttcttttgcctatatagtgatcattctttcccctgcacatagtagattatctattaaatgaatctcctaggtactagggcactatcaatactgttcttgtctgtattagtccattttcacgctgctgataaagacatacccgagactgggcaatttacaaaatagctttattggatttacagttccacatggcaggggaggcttcacaatcatgtcggaaggcaaggaggagcaggtcacatcttacgtggatggcagcaggcaaagagagagcttgtgcagggagactcccatttttaaaaccatcagatcttgtgagacccatttactatcaggaaaacaacatgggaaagacctgcccccatgattcaatcatctcccacccggtccttcccacaacacataggaattatgggagctacaagatgagatctgcgtggggacacagggtcaaaccatatcattgtccttactgagaacactgaattatgtctggtgctcacctgacctgccatggatggcagcatgtagtactaggccatgcctagcacagcctctagccaactcctttgtagtctcaaattttgacttggaagtacttttgaatcatcaaataaatagtaaattccttacagagttagaactgctatgtttagctttgacttgtttcctcctcaatatttaatttttttttttttgagacggagtttcactgttgttgcccaggctggagtgcagtggcacgatctcggctcaccacaacctctgcctcccaggttcaagtgattctcctgcctcagcctcccgaatagctgggattacaggcatgcaccaccacacccggctaattttttctattttgagtaaagactgggtttctccatgttggtcaggctgatctcaaactcctggcttcaggcctcggcctcccaaagtgctgggattacaggcgccgtgcccgtcctcaatatttaatttaccagtgttaatttggaaatagtaccaatcagtaaaaaggtgtcaagagcttgttttcttctgaccacttgatttctatagcatagagataacaccatattttcactacttccccagttgggtgatgtcagcataagttatatctacacttaccaaactctccagaacagaaagttcttagcttggattacatacggatatataaggcatgcgaaatgttctaatgttacagaagaacattgctagcactcagatacttggagccattcttcaggtgaaagtgatatcttctgacattagtattgattgcattaatactttatttacaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaa

SEQ ID NO: 993 - DNA, 615555 bp, Homo sapiens
cttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcctgctgacgtcagcgcctgcctacgccgccgttcccatggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgttttattcttggctttttttcaatggacagtatatcttcaaggacttctacaatagcacatatagacctgctttatctttttttaaatgtctgtctagtactgcattatatttatttaagcagtcatctattgacagacgacattaggttgtttccagtctcttgttactatggacaaagctgcaatgactatctctgcacattcatcatttctcacacaggagtagaattcttcttcatttgtaacattgacagatattgacaaatttctctccaaaagggcttaccattttgctctcactacaatatgaatgcctgtttcttcaacccttggcagtacaataggttacccactttttgatatttgccaattaggtaggcacaaatggtctgcagttgcagttttaatttttattatctttatgaatgaggttgggcctccttttatatgcttaaaatcatctgcatttgctttactatgaattatttgttcttaatctttacccgtctttatattgagttggtgggtttttattttccttactgatgagtgggagttccttaggattaaagaaattagctcttctaaagaatcggtatacatggacagacagagtggaataataaacattggagactctgaaaggtagggataaaatactgcctactgggtacaatgtacgctatttgggtgatgggtatgctaaaaccctagacatcacctctatgcaatacatctatgtaagaaaactgcacttgtacctccaaatctatttctttttaaaagaaattagctcttcatctagagtgtgagtggcacgtattttttcaagtgtgttttttccatttgttttttgactttttattggttttctttttctttttccatgtagtaattttaaaaaatatttttctgtggtcacatttatcagtttttttctcttatagtttctgggtttgcatcattcttagaaagtcttcccactcctagggttactaagaatcctcttaaggtttcttttagtaccatcataatttgatttttacatttcaaatttgactgaattggttcttttaatgctttacactctaccgaagtataaaatactgcactgaccatgtttgttttgtttctggttcagatatttctagtttattctcagttttcttcgtttgtgaaatagagataataagtattactgagtaccatccatgacttttagtggagagatgccatcttgatgactgaaagctaaaccagagttttcttcctcattctcattacttagaaacctttgctgatgattaggtttggtgccctaatgggacaattgagactaacacggtctataagataacttgcttcaatttaaaaaggcaaaatcaaattagccatttcatatctgcctacataggggctactgctttcatttgtaatgtttaattacatttttttccccaagaatacatacacacggctatcacttctaaaataattttggctccctatgaagcagaattggaaagtgtcttaaagttagttttgaattggttatttggaattcaaaatgatacttcattaaaacaataccttaaatattggttaggttcttgagccttattacaaattccatacttatgtatttatgattcagaataggaggaatggtgctatgtcaatgacatgtaatgatatttaataacagtgtgtccctgttaatatgtgtctgagtggcatatcaggaatcccaaatatgtcttccccagtccttcccgtgcatcctagcagcagatgtgagaaccccaatagcccactgggaactggttgcaaggccagaaaggacactctggtcaggagaatacctctttatattagtaccagggaaagctgttttctaatatttggcagttgtcctgaataggataactagagaaattaggtctgtggtgtagaatttcagaggcgtatcatattttttcttggcaaataatatggttttgctgtatccccacccaaatctcatcttgaattgtagctcccacaattctcacgtgttgtgggagggacctggtgggaggtaattgaataatgggaatgggtctttcctgtgctattctcatgatagtgaataagtctcacaagatctgatggttttataaggggaagttcccctgcacacactgtctcttgcctgctgccatgtaatacgtcccttgcccttccgccatgattgtgaggcctccccagccatgtgcaaccgtgagtcaattaaacctcttttctttataaatcacccagtcttgggtatgtctttattagcagtgtgagagcagactaatacagcaaacaattagctttagggaagctggcaagcatgaaatagcgtcttagccatcaaggtgggttttaagggaagggaggtcctggagaagagaaggcagaaggcagatccccaagacaaggattcagccatacacagaaagaagatagcaatgtaggtgtctggcatgggaagcaaggtgggaattgaggctcgagaataagaaaaaatctagatatcaggactaaagtctaagactacctagaagagtgaaattatgctgagccccacactgatggtttggagataattcatctccagtgtttaaggtagggacctgggaactgggccaaagcatgggtgaaaggtgagaatgaagcgggtctgactgtggggcaaggagaggacagtggctgattatgggacagggaagatgtttaccacctctgagtggaagtttatcaccaccgagaaagtggatgaccattatttggtgaactacttatactgctgtattttgtgtatagtactaaatatatatatatatttgtttcaggattatttaatggttttgcccatgtggaaagaggcatatgcttattctatttctcaatgacatttatgagtgctataattataataacaatgatgaaagtttgactaatcaatatgtaaatagtacttatagtgagccaaatctattagaaagccagccagtctaaaagagaataaagttcccatattgcaaatacaaattatgatagtttggaataaaaatcaaattatattttgctctgtgatgcattgtgcatgctatctatgttctttgcgtctccttccatctgtcttcccgctgtttccctgctcattaacacctctactagaaagtgggcagggtgatgacaagaaataaaaatacaagttgaactgcaactaagaatttaacatttaaaaaatgccaacgtaagaatgatataaatatctcaattgtgaaaatagactgcgaccctggttagtatatggtattttaaatatgtgaaaaatgtgaggaattggagcacatcccataaaaaagaacaagttcacagaatgttatcaagggaaaggactgcagagatagactgcaggagcatctttccatacaggtgggaaatgcagaaaaattcattaaaaaaaaaaaaacgaattagcaagtacgcgtaaactctgaagacctaaacacatttctggaagctaactgcaaagcttggcctaaacatggaaatgctgaggtcacttgctggagtcaggtacggcatctgcaatggaaagatttttttttttttaaagaaggttatttcaacattttcaaaaaggaggctggggtggaaatatatgacactaggtaaatatacatcaaaatatttatatcataataggcatgtagtttatttaggctacttttattatgtttatactttacatctcaagatttctacaatgaacatgtatcaattttattatgggaaagtgggctttaaataaaaaatttatgttctgctctcatttgcttatctgtcagtggagtttcttcagtgaattttactagtcaacccgtttttacaatgggattgagacagggatcaatgctgggaatttctgacatgcaaatgattttaatgatgaaagcatggagtttagtcccaatgaggtcatgtatgcatgctgattagatttatcagactgcttctaagcaggaaggacttttaaaatttaaagattgagcgacccaacttataggaaattcagtggctcaaactatattttccaagtggtgtgataagataattagacacaattaacttgcagctagaagacaattaccaccacaaaatgttaattgtttgttctagaaattcctgcattcagtctcaaattagaagtatgtattaatatatataatattatacaaatatattattcattacatattacatgtaaaagctaattgagtattacacatattatttattagtgaatctccctgagcttcaaggaaattatagacttcaaaaaatttttgtggcctttggtacaaatgaagccgattttagaatttcacagattcttttatgaggataaataagtttttgtttatatttttgtggtacaaacctaataaagtgcccaaatcatcggcctaaacatggaacttatttcaagatgtattgattgatttaataacacaaagttgctgaagtttttaagatatattatctgaaaccaactggaaatttctgattatatttccaaatctgggcaaactttggtgaaccctatgtctgtgaaaatgcacacttgcttatgaatctgataagctttattctgagatccactgtgagtaatgcaaaactgaattcagaattgaggatgtcctgagtttaccccagaattcaccaaaatattctaatttgttaaatacaaaaactctcattgaaatggatgaaaatgatcatgattagcattaaagccgtaagtgtagattaagtagctttctgtttaatgcttctaaatagaatgcttctaatggtacacccatgttattttctattaagatatattccactcatgtttatcaataaaagctatatgtatcacacacatactgatttctgaaaattgaagtttatacaagtaaagtaattttttcaaagttacagcatggctggctagaacctaggtatgcaaaatcatacataatcagtggtcattctacgaaacaatgctacttctccctgtcgttagagaactaggagggacctttgaaggaatttgataggaactgaaagtattgtcatgtataattataagaaagaaaggttaaagtgtttcccaaaataatttttactttataaatgattgattacaaaaagattagaagataagattaattaggtttgtatgcctcttttacaatttattacttgtcattgtacaagttttaaaatttctgccttttgcttttcatttttaaaatggggataataactgtgcctgtatcacatggttgtattggtgactatgatttaataatataaaaggcttggacaatgcaatatatcagtgtagcaaaatttcatttataccccatgattatatacaaataaaaaagagaaaaataacaataataaaattaaaataaaataaaaaatagctttgcagtgaaaaataataatataaaaagcttgggacagtgtttgacacatcataagtgttcaaaaaacattagatgttattatcactatatgtcaagcactatgttttgcccttagtatacataattttaatcattccttacaacagcagtgggaggataaatattatcattcccacatggcagttttcgtaagtgaccatttttgcatggctaatatgattaaaagtcaacattcatacccagatctgtgtaagtctagaacagcaagttggtaaattaaaaactattttacattttcaaagagttgttaaaaaaatgggacagagaccatctgtagcctgcaatgcctgtaatacttactgtctgaacctttagagaacatgtttgctgactgccactctagtgcagttttttcttctgtaatatcagactaggctgcctcctgaaaaccagatgcctattttaattgataaaatcattcatgttttcatttatttgacagatatttattgagtacttgatatttgtgaggcgtgtgtcaaagtttgttcaggctgctctaacaagataccttagactaggtaatttacaaacaacggaaatttattgctcacagttctggagcccagtaagtctaagatcaaggcagcagcagatttggtgtcgggagagggttcattctctacttcatagatggtatcttcttgctgcaccctaacatagtaaaggacaaacaaacttctttgtcctctttcataaaggtactagccccatgaccgaatcacctcccaaaggccccacctcttaaaactattgccttgggaattaggtttcaacatacaattttttttgttgttgggttgggggatacaaaatttagatcatcacggcattttctagacctgtgggtaccaggtctaggaaaatgagtgagataataacatttccatcaagaaagttgcaatcctgtgaggaagtctaagagaaaatagacaatcatgggacagggtgaaaggtattttggttcaatatcacaggcttctgtggaaacacataggagggactttgaatgtagcattaaggagtcagatataccttcctggtggaactgatacttgaaataagtccgaatttttagtttaagagtaggtatagagtattctaaattactggagaagcaaataagtacaatgcaaaaagaagtatgagaatctgaaacgtagttgaagtttatggtaatggtggaacttaggaggagggtccctgttaaaagagagggtgagaaagaaagagtgcaaagtataaatatcatgcatgtcgtgctactgtttaaaatttatcctgaaggctatgaacattgtcacactgtgggattattggaaactttcagcagggaagtgacacactaaaatttacattttcgaatgatccttctggaagcatgggagatgaagaacaaggattcaagagtgaggacagggcttgcagccatggagttaaagggcctggatttaccctcatgtcttgatcaactctaacattacatgaagaagacttctcctcagacattggacaataggcagcacaagaaggactgtgaatctcgggggaagagaagtaagtgaggtgagccctgcactgcaattgcctaggattttcgcctggaggcacattttagactgcagagcagagagggagattccaagcaaggaaaagttgtcttatataattgaggaggcagaacttgaagtttaggaagtctggtgtctgtaaatggtgaggcagagatctacagagtagggagctacacagaaaacgggcttgagaaatatacacagtgggtcccatgagtctgaaaaatatcaagacaatgcacagcgtgaaatgctacaaggctgggcaaagaacaactgtggagttatgagaggagcgtatttccacaatacacacagactgcggaatcatttgcattaccaccagatagcatggagagccctcattgagcctctttacttggagaatgcagtaaagactccatccagaaggactactctgcagtagtgggctaacccattcctagaggaaaggtttctctagccctgcccaagcacaacttaaaagcaagtctcaaaaccatctaactaaatacttatattagaaaagaagtagtatcaacaatcaatgatctaaatttattagagtctaaattcccaccacaagaggctggaaaagagaagaaaagttaaaccaaagtaagcagaaggaagagaataaaaatgataacaaaaatagaaaacccaagacaaactgagaaaatttatgaaaccccaagctgggtttttgacaacatcagtaatattggtaaatatctagcaaaactgatacaggaaaaaaagggaagacaaaaaattatcagtcaagaattaaagaggggacatcattaactatcctatagattttacccagataataagggaatattagtaacaaatttataatgacaaagttggattgttgggaaaagcatcctgtggtagcagtaagtagccatccaacaaaagccactataacaataacaaaaacacatcattcattaaccaattttatgtggcaggtcctggttaaagacagtggaaagaaaccaaaaccaactaaagaagaaaagcaaggattatttattcagtgtttgctatagcaaggggagtctgccactgtcacttgtgttttgggagagaatcaaaggcaagcagaggagtgggaagcttcatagtgagaaataaagggaaggcttcaatcataccctgactggaggctgttgtcttggggaagttggaggtaggctaaccagaagcagaacatcctctgtgattgcttaggggtgcatatttggctttctctggtttgtcctaagtttggagtggggacagatattgggaaagctgtcagttatgaatcaagtcctggccattttgagccgattgttacagaagtttttgcttagcttcctatattgtttctacagatagcagcctgacttatagcaggctggcttcctggactatttattgaagttaacagattggctttctggacaagattctggaggttgatggtcaaagttctatttttatacatggattagttcatgtcagtttgtatattcagtccctcagtaataaatgatatagtgatacccaattcattctgaaagcataatgaaaagagtgacccagtcttcctgggagcatccgagaagcctttacagtgaagctaatatttgaagttgccttaaattctgaggcaaaaagaagatgagaagaaattgctaccagagatgaccacattaaaaaaaataataagcaggtgggtgggtggtgtgtttgaagattagtgaccttttaaagaagcttgaacataggcgggtggaggcagacagccaggaaagaaaggtggaaccaaaatgtaatggactttgagtgttgttctaagatgtaatcttatgggctccaagggagacaggatgctttaaagccaatagttataatattagacttgtattttaggaacatgatccttttgatagtggaaaatatgcatggggtgggtcaggaaactggaaacttgcacacaagctaggatggtattttaccaattggaggaagtggtgggaaaggccttgatttgggcagggacggtggggatacagcaaagggcagatagaacaaccagggcaacattttggacatgcagtgcgtgctccgtaaatatctgttatatttttaagtgaataaatgggacatttaggaagtggaatgggttaggtttggtgactgattggatattataaggacaggaaatagtcaagaactactaaagtttttagcttcagtgactgattgtatagcaatgctatcagccaaagtgtgaaaaataggggtgtggcagtttatgagtgaggatgccaagtttcatttggggcatgtctttagggcttataaaattggaatcagggtttgggggggtcactgatggcacataggtaatagctggaattatgcaaagaggtgggattggtcagaaagactttccaaagctaggggagagggtccagtccttgaatgcactgattctcactttttaaaattatttatttattttttttgagccagagtctcaccctgttgcccaggctggagtgtagtggtatgatttcggctcactgcaacctctgcctcccaggttcaagcaattctcatgcctcagcctcctgagtagatgggactatgggcacatgcccaactaatttttgtatttttagtagagatggggtttggccctgttggacaggttggtctcgaattcctgacctcaagtgatccacatgcctcagcctctcaaagtgctaggtttacaggcatgagccaccatgccagcctgcactgatttttaaacagtggataaaagaggaagaaacagtgtttgccattaaatactgttgtgtgctacttctttggaatttttcctttagtttcttgcacacagtttaaccattcatctacttgtatgtagggagatgaaacagaataccttttaaggaaaactatggaaatcacattgggtggaatgtacagaattcggagactctgactctttgagtcctgagctttgcgtgagggtgaatgacctgttgcacaaagggacctgagttaaaatccaagctcacctaatttctgtgaccttggccacattacttttctcagttatacactgaggttaatgatatctattttaaagagtttttaggattaaatgagataattctacataatatatgtaaagtgcccactggtgtcttgcatgtagtttgtgctcaataaatataagttgttattatttttgaagacctagaagaatgacactcaagaaaagccatcaatgcaatttttttaaataaaataaaattatggtattatttttgttgtttatattgcaaagttgatcatgtgaatttcacatttctctcttttaattctcccctacctaagaaaaaacaaaatcaattttttttctagagagggattttgaaaaagtttcaaaatagcattttcaaaatagcattttattatttctttggttcaacacgtgtttatccttatctaaaattaccctgaagattatttcctaatatggaataaatgcttctaggttacaagcatttattgggtgccttaccatgcatcagttactgtgctcaatgccagaatacaaagatgagtcaggagacttctcttgagaaattcattcattcatttactcaattaattatttatgtaactccttctaaagggcaagtgcttatctcagtggtaaaggtagagcagggatagaataaatgcacaaaaagactcggagctttggcagactgtattaaagtgaagggagacatgagagaaaataataaacaggtaaatcgagaaggtaagtttagatgttgcttagtggaaaaaaagtgaaaagaaataataggtagagattgattggaagagaacagcatgtgtggccagatggcctctggggattggggtaggattggggaggaggatgagagaaatgagtcaaaataattattataaaacaaaaatattgcataattgggagcaaaggaaattatagacatcacgcacacaaaaaaaaacagcccaaggaggaaaaagctataaatgcttaaaatatattaatttggaatcacattttaatcattttagaggttttatatgctcatgactcccactttaacctcattcttgaactaatgataatacttaaggtagggggaaaaaaagatctctttctctgttctcccaaatactcactttgggtaaacatcctgattgcaaattaacctcagtcatgttggatagaatttttgttataagtaagatttttgtgttggtcattctcccaaccaagtagatcttcattatctgtatccttgaagttctagctacggtctttaaattatccaaccagcatgtagaatcaaagtgatactgaaagtcataagactttgaaactagaaaggaccattttgtctaattcatccttaattcgcagcaggtggaatggaggctcagaaataaataacagagagtgaaaaacagtaattggcagagcaagaacagaaaccctggtttcatatcaccagattcattgattgagatctttccagtcttcccatctattcaagaaactagcacttcctaaatgccaggcactgtaaagctctgggttcctggatgagtaataagtttctctgcaagaaaacactctctcattccctagaacattgtagagtactaaaagatgtctcaattaagcaaatgataattcataacctctcaaagtacaatagacattattgaaaatgtctaattgtcacttgagagcaaatcttcgacatgcttattctttacccttttgcatcaagagttttaaaaatgatatttcaatggagaaggctttggaatgatagatttggagcttaatctagactgagacttaccaccttttgacctaggaaaagttgttgagcttcactttctagtggcaaaatgtgaccaaagttaccagcccaatgccagggactcatagaacttggtgtgttgatggaactgtccttcagttgcactgcttgaggttaggaggctgcaggaggttgggctgagaaggcccttgggcccacagtcttcaaaccccagtacacccagctcttctctacttccccaaagctctcagggccctttgcaaacaagaactcatgcaggacagtgaactctgccctacatccaagggagaaacctgaacttgggagttggaggttgcaatgaacactacatcaccggccactcctactcagcctctgtgattagttcttctcatctctgatctctgaatgctgtcatgttccagggctcaatctctgtagtgcttttcttttctgtctacattaccctttgtcatatcatccagccttctgattttaaatgccatctatacataattctgatgtatatattaactctagagttggaagtctcaactcatatttgactacctcctcttggttgtctaatagtcaattcaaaattagtaaatccagatcgagctcctgatttccctcaccaaacttcctcctgggtggtctttcccaactcactaacatggcaactccacttgttttttcagttgctaaggtcaaaaactgtattcttgatttctttttcttacatccaacattcaacctatcaggaatcttgttggttctatcttcaaaatatgttgaaacctatcttttaaccactttcaccactaagagtctggttcagcccccatcatctcctgcccagatgacgcaagagcagcggtctcagtttcagtgctcagtccctctgtttctgtattttccctcttactgtctactttcaaaagcggccagagtgatcagagtgaaatggaaatcagatgttcctcttctgcccaaagttctctactggttttctatctcactcagtgaaagccagagttcttagaatgatcccaaatgattaacagggtctgtcccataacaattctttatttttctctgctgttattctcctacccaatctctctacttcagccacactggtcacttaatttttttttttttaacattcatggaaacttctgtctcagggcttttgcacttgctgctgcttttgcctgaaatgattttccctcagaggtttgccaagctcttcttccccaccttctgagtgaggaatttcctgactatcctatctgaaattgcaaagctccctccaaccccagtaccctccaattctctttgtaactttatttttctctctatattatctgcctatgtatctatgtatctatctatctacctatcatctatctatttttctatttatctgttgtttatatttccccaataaaatatgagcaatgtttttttcctttgttttccgttttatccatttctatatccctagtgcctagagctaagtcctgatgggtgggaggtgttttgtaagtatttgtgtgataaataagtggtgttatccttaatagttgtacaatatttttttataaaaaggcattttgggccaggcgtggtggctcatgcctgtaatctcagcactttgggaggccgagatgggcggatcacgaggtcaggagatcgagaccatcctggctaacacagtgaaaccccgtctttactaaaaatacaaaaaaaaattgggcgcacgcctgtagtcccagctactcaagaggctgaggcaggagaatggcatgaacctgggaggcagagtttgcagtgagccgcaatcgcgccactgcactccagcctgggcaacagagtgagactccgtctcaaaatataaaaataaaaaaataaaaataaaaagacgttttgcttcatttttagtttatctgtttttaaataaattctaattctttagataatagtgggctttagggtcaaggataaagtgggaggatatatcaaaaccacctgcaacacaccaaaaacagaaaaaatcatagacagtgaattttgcaaatgttaaaaataaaccattctactcaaaaaggagagagagagagaagagggagagagacagagagagagagagagagagagagaaattcccaggggctagaacagagaaagtccatcagagttggggttaaagtgtcatgcccaatggcaaagaggaccaaattaggaaaaaagggactgaggtttcagtgcctgttcaggaggtggagttaagggtgtgttggccaaggtggaggaccacagtggagccaccagtggaaggctggaggtgggcaggggtgaggtgttgagttagttccaatcgatgtagaggaagaataacccatgaagggctggagcctggcccatatcacttgcatggggccccaaattgcacaattcaggtggagcagtagccttcaggttctaatttcagggtgggtttagagccctgaaacccagagaaccagactgtgcacatcaaactcatgatggtcttgcctctaggaagggtggggaagggaggtggcaaagaggactttacctacagtgtttattgaaaggaacaatacagatgtgaagaaattgttatcaattttcaattattgtgaaaatgtggattttttctgccattctaagtacttttctgtaattattttaatatcacaattattttcaaaagaaaaaaattaaagaaatagggtagtcttttaaaactaagagtatctagtctttctgtgatatttctagtgacttaggtccacttcccatatactttaactggtagtatcaggagtgattttaaaaaagagcaaatgtctattaatatatgtttttcctattttgtttgaatgataatatatgacaatctgttaaaaagtactttcttgggttaaaagtaaaaaaatgaaatctgattttttccttttgttaccttgatcaattgtgatagcactgacttagatagaatgcaaaccataggacaactcatacaattcccatcctatggcattttatagtgaaggagaattaaagtcaaaagaggcagtcaagtatctttggatatttatacgtaattgtcaagtagactttatattaagtgcatagttgtatgtgttagtgtattgctttattatttatttatttattaaattccatttttattttagatttagggggtacacgtgcaggtttgttacaagggtattttgcataatgctgaggtttgggcttctatagatcctgtcacccagatagtgaacataggatccaatagaaagtttttcagcccttgccccactctctccctccctccttttggagtccacaatggtgtctatggttcccttgcttatgtctctgtgaccccaaggtttagctcccatttataagtgagaacatgcaatgtttggttttctgtttctgcattagtttgcttaggataacagcttccagctgcatccatgctgctacaaaggacacaattttgttctttaaattaaaatttaaaacattttttaaaagaaataatccaagatgttttcttgcttagtgaaaactgctcaggtgtacatctggaatatttatttgctgtaagacttcctggaaattgctactggatataataatgtactattgatatggtttggatgtcccttccaaatctcatgttgagatgtaatcctccttggtgggtggacaggcagggggcctggtgggaggtgtttgggtcttgagagtgcatccctcatgccttggtgctgtcctcaccatagtgagtgtgttctcatgagatctggttgtttaaaagtgtgtggcttctctccccaccaccttgctcctgctttcaccatgtgaagtgcttgctcccactttcccttccaccatgaatgaaaacttcctgaggcctccccagaagcagatgctggcatcatcttaggaaggatgcagcctgcagaaccatgagccattaaacttattttcttatccagtctcaagcatttctctacaacaatgcagaacagcctaatacaactattaatccatattcatgtctataccaacagcaatactttgctgatagcaaacgggtatgtatgctaacactcctgaaaaaaaaacaccttccattttcctcaaggccaatttggaataagagaggcattgttattctgcatcattgcatcatacatcatgctttcagatatgggatttcgctcttgaaatttcaccttttaaaagaaaattctctgcttttcaaaaataaaggtattttctttggagaaataatctccactcaaaatgtaatttaaaaaaaaacatgcttttgaatcacactcttgcatccccttttcactttttgttttggctcactgcagatttgaaagctgctaaacagatcttactcaaattttccaaaacaattctttattggaaaaagattaggaatcagaaacgtaaaattatgagcccaagaatgctcttctaaattttaagaatttgatgaatctagatatttaaaataaaactccttctcttgtatacacttacttaatttttccattgtaattactcggcatttcatgtagatgcacatatagtcaaatttttatatgatctgcttggttcttacatccaatcttggcaactgtggcctgggatgaaagccaaatctgttcctaacagagtgattatccattcttccattacttattccatttagagtatgtggatatgttaatgtctgcagaacattttaagatgttcagagtaaaagagctttattaattccagatttgtgaccaaagatggggatcttttaaatggaaatggcaattgggaaatccaggacataaaagtagaaggggcattttaaccaaggagggatgagaaaggttatgagaaatagaaatagagagatgaaaatataaaaagagatctggatctaacacaatcccaggagtaacattccaggagttctaacaacaactgataatgtcttaacattgatattctcatcaatcgtaactgtgcttggaagtcatacgagacactaataatatagtactcgtgatgggcttaggttatatgccattctcttggaatttcaaagggttagaatagctttcatgaagtgagagtgaagcatgtatgcttgtcttcagaccatcacaactgagaaaaataattatattaataaaagggcttaattagaaaggagccatttgagaagaattaagtcactttgattaatataattacctttctcacagaattaatcaagatttaactttaacatataaccccagatcacttgctagaattctgtgtgtctgaaaaccaagttttgaaactcacttttcatgtagattcattatcctggtgttcccaaacttagtttatcagctggaacaactgtggagctttggccaccaccccagaccactaactcagaatccctaagatggagactgggaatttaggttgcttgcttaaccctctacatcagaggtctttaacctttttggcaccggggcccgtttgatggaaggcaatttttccacaatggggcagggagagggggatggtttcaaggtgaaacttcctgattctcagattcctgaatcctcagattatcaggcatgatttagattctcataagaagcatgcaacctagatccctcgcatgcacagttcacaatagagtttgcactcctatgggagtctaatgccactgctgatataacaggaggcagagctcaggcggtaatgaacgctcacctgccgctcacctcctactgtattgcccagttcctaacgggccacggactggcacaggtccacagccctggggttggggacctctgctctaggtgtttgggcccttgcatgatggggatgagtttcaaatatcaaaacattcagcactttgagtaacttgttaatctttggtatataacataacaataaaatctatcatttattgttgtatactatgtgccagaggataacgtgcattttctccatccacaccttaatgcttccaggcatcattattcccatttgacagatcagaagttaaatagcagagcaagtctctggtttgcctaaggttttacagttagtaaaaggcagagccaggattccggcacaattcagcctaactctggagcttgtgagcttctcagagtagcatccataggatgttatgatccttcatacaatggcctgcccatgtatatgaggtttggtgttggcatatttaataagaagagttttatatttatttccacaaagtcccaataattttcagctggtaagaattctgagttgtgagatggtaacagaattctaagcctggttgtctcacaatcctttagctgataaatgctttgagatttgcattttaattataacaaggacaaaaatatggaaaatacaaaatatattttctctcttcatatggaagggagaagaaatgtcttctcccttaggagctttgtagtaaatgaaatgtcccattcttaagcttttctctctttgccttcttcttactccccttcccacgctaggtttcagttcattcccaacagtgcaggtggctgtaggaggtacaacttggctgaggaggagaaagcccattggtaatgttctcatgttcttctgtagatagagtaagccttttccacatctaaagggctttgaaattggcaggaggattggaacctcaatcctcattcctaagtaatacttctaggtttccagcaactcatttaatttttgattcctgtgatccattcttatataaggttatctgcaaatttgatgtaatctgcattgtacttcaacaaaccacaagtcaagggtttcttactgtgagtttcctatagaaagataatgctgtgaataaaaatcctacaagaaataaaaaatcatggcaggctccgtagaagcagtgaaatatatccatcttttaaatataaacatcctaaaatgttaacgcagaaagagtaatagaaaatacgtgaatattgaaatgaaccaattacgcttgctaataaaggtagtcttgccagtttgcatcaagcttttggttctcaggaccagcctgcatgtgtgttaagagttgctttgtttatatttttatctctctgctacacgctacgcatcaagtaaacatggacaatgccttgaattagaggaatgaacatgtttttcgggcaacctggcaaccgtgctgagggagtgtatttcacattcactttctccactctcctgaagttgtcaggctaagtgcctaccagctgggtgtttacactttggggctaaggaggggaaaatgttttggcttatacacactgacaccaatggctcaaatcccagtaatttgagggacccctgttgttccgcaaattcctgcccattttctagttcacttaaaacatgctgacaattgtcttgtatgttctatcagaaaggaggactctgtcattgaagcaaaaaaccattctgtgcacaagcagagtgtgtgtgattaactcacatctttcatacaaatatgtatatataattatgtttaaatatttatggaataatgatcacatttctatgtgagagaggaacaaaaatagcaattagattgcagcttggctgtggggcatgtgtaataaagcttatcctacccttcacccctgcctccaggctatcagagcaaacttttttgttcaaactattgtatcatataaaattttaataatattttgaaagaataaagggctgtcccttctgtggcattattccacatcctgacctcatctttggtaggatttcttctttagagatatgtactctggcatcatttgaattacggagcagaacaattctactaaaatgcccaagaatacaataataaaatgtagaaattttaacttcttagagacagatgcaaatattcacttctccatgctcacagatgaaattagtaaataaatgaagagcattgatttttattttgttccttttaaagaaacttaacaactgcacaggaatgtaaagatgtatgaagatgtaattatagcacaagccagcatatgataaatactacaacaatggtacaagaacagtcataggagattacagattagggggcctctgtttctagcaacaggatagatgagatcgtctaaaaactttccacacaatacattagaaaagctggatacaattatgacaaacatctttttaaatgcacagttaataatttgtgaaaataatgtaaatttctaaatagagagaatgagaaggggatcttgaaaccaaaaagatgaccccacaccatgcataaaactgtcctgggaaaataagtcactcttagcaaactagagtcttggatttgaaatgggtgcccatgtgaccaagagccaaagcctttggcatgtgcaaagtgaagaagtatatccctgtataaagctagaattcttcaaaagctacacattagactggtgcaaaagtaatggcaaaaaccacaattgcttttgcaccaacctaatatttagccagtgaaatggtgaattaccaaaacaaacccccaaataaaaaatatagattaggaacacggaagacaagaaaatgtatttctcttcacagggggtctggatgagtgaaaatctccttcaaaaattgataactgcaggactgtccttgtagggcaatttggaaacctgaagtggagaaataggcttgctaagaccttgcaggatttagagataaagcccagaaaaacatgagttagcaataaaaaagcaagcttactctgaggaataagcaaccttgagcttgtttgctcaagcacaatttgactacaaggacttcagatactggacttattatatccaaaatttaaatatatttcaaatatataaatatgtgatgcagagatttaataacattagcaaggaaaagagtactatagatcgagtatccctcacttaaaatgcttaagaccagagtgttttggattttggattgttttcaatactgaatatttgcatatacttaatgaggtatcttgggtatggaagccaagtctaaacaaaaaattcattttagaaaattgttttatttttattgatttttttttagagacagagtctcagtctcacccaggctggagtgccacgtggcgtgatcataactcactgcagcctcaaatttctgggctcaagtaatcatcctgcttcggcctcctgagtatctgagactacaggcatgcactgccatgcctagataattaaaaaaaatttttttttgtaaaaacaggatcttgctatgttgcccaagctggtctcaaattcctgggctcaagctaacctcctacctcggtctcccaaagtactgggattataggcatcagccactgtgccctgcccatttatgttttatatataccttatacacatagtctgaagatagttttgtgtgatgtttttaataattttctgcctgaaacaaagtttaaatacttaggaatggaattttccgcttgtggcattatgttggcactcaacaagttttagattttgaagcattgtgaattttagatttttagattagggatgctcaaccagaataaaaaagactgatatatagatgtgtaagaatcaaatagatcttctagaaattaaaacaaaaatgtcgaaatgaattttccattgggtgggataaacagaaaagatacagctaaagagagaattaatgaagtataatataaatttaaatatatttcccaatatgcataggagagagacactaaaacataagaaccaaaaaaagagattaaaggacataaataataaaggatatggtgtaataaatgtctcagtagttcaaaaaataggcctttagaaaaggcagtgaagattttgattttcaattcgggaagcagaacaaatcccaataagacaaactaaaagaaatgcacacaagacacaccacattgaaatattatggtaatatatgcagactatcacagacacaagtcagattacgaacagtgagaaagattatctgcaaaagaatggcaattaggccaagagctgacttctcaataacgataatggaagccaaaagtggtccaataatactttccaaatctagagaggaaaattgtcaaactagatttttatacctagaaaaccaactttcaagatcgaaggagaaattgagacattttcaagtaaatccaaactgaaagtttatcactaatgataccttataacagatatttctctgaaagaggaaaagtaattccagaggaaaagtctgagatgcaagaatagggaacaaagaaatctctaagtttgtaggcacagctaaacaaacatgttataatatgcacaatcttggaaggttaaaaaatataagacagcatggtaggcagaataatgaacccccaaggatgtccatgtcctaattctcagaatctgcgaatgttgttatatgacaaagggaaatttatttacttatttttctctaagcagtccctcctttttcatttgcttaattaatttttttaaaatgttaataactttaggggtgcaagtggtgtttggttatatggatgaattgtatagtggtgaagttgggcttttagtgtacctatcacctgagtagtacacattgtacccaataggtcatttttcatccctgagcccatcccactctccctccgagtctccagtgtccatgataccactctgtatgcctttacatactcatagcttaactcccacttatagaagtgagagcatgcagtatttagttttctgtttctgagttaattcacttaattcgttcttttttatggctgaggagtattttatggcacatacaccatatttctttatccactcatctattgatgggcacttaggttgattttctatctttgcaattgtgaattgtgctggaattaacatgtgcactcaggtgtcttttttatataatggcttcttttcctttgggttgatacccagtggtggatttgctggatcaaatggtagatctacttttagttctttaaaaaatcttcatattgtttttcatagaagttgacctaattgaaattcccaccaggaatgtataagcattccctgacaaaggggaatttacattgcagatggaattaaggttgctgatcagctgactttaaaataaggagattattgtggattatctcctgggcccagtaagatccaaaagggtctcagaagtggaaaagagagacataaaacagagtcagttagagagagatgtgactacaggtgaagtcaaagtcaatgcaatgtgagaagtactcgaccagcaggatgaaatagaaataataaaataaggtagtataaatcattccaaaaaatcagtagtaatgataaaataaaaatatattcaactcactagttaaaaaatatagattgtcaaattgagtaaaaacatcaaaatctagctgttgctttttataagtgacatacctaaagtgtaagaacatggaaagactaatggcaaagttatagaaaaattatgcttagaaaatactaacaaagcatgtggctggtatagctagattaaaagcagatcaaacatttaaaagtaaaaatattagtagtatcaaagaggattactacataatgataagaaagtataatctaaagaaatatacaatcatttcaaactttcacatgtcttaataacatgcagtactttgaaaattcccaaagcaaatcttgacaaatttcaaagagcaattcataagtcaactgttgtacttgaaagtattaatacttcttaatgaatggcagttcaagcagaaaaattaataagtaacttgaacaatatagttaacaagcttgagataatagacctacagagaagctaaactcaaaatcacaaaacacatattattctcaattacacgttaaacatttataaagtgttaccatttatattcataaataggttgcaatagacaaaaaattatatagactcaattaccttatcaactcaaattagtaatcaataacaagaatataacttaaatgaatctattcagaaattaaagttaaaaatttataattaatttatgagttaaaaaaatcataatggaacttaggaaacagaaccgtatgcttttttagacacaatattgaaatttgtgaggcagagctagagtattaaatacttgcattaggaaagaagaaaagtgaatactaatgagataaacatacaaattaagaatttttcttaaagaacagaaaaataaaacctcagggaaagttgaaagaattaataaatgtaagaagagaaactcatttagtatgtaacaaaggagagaaacacaaagtcaaagctgttttatagagaaagctgataaaatagataaagctatagtaaatttgagcaaaagaaataaaggaaaggtacaaataaactattaagaataaaatatgcagcataactacaaaaacagaacaaatttactctttcagaattaatactaaaaacaactttgtggcaatatattttaaaaatgagaaaaaaaatcctagaaaagtatagcttacagaattgattcaagaagaaatagaagacctaaatggaactataatgaatatggcaactgacagtagttacagggcagagattattggatgcttaccaatgctatttcctcttcccggaagtacatctgccttgccattagattgaagctacaagtttggtactagtcagtggaatgagggcgaaaaagataattataggactatcctccaaaatctttctttcttaaaatctttggcttgctttcatttgcagctgaaggtaaagaaatttcatgtggtggattcctacaaaagaaaaagctgcaaaagagtcaaccaggaaaggtgctagacacacatccaatggctgctgagtgatgaatgagaaagaaaccttcggtgtagtaagccattgaaatttgggggaaatttgtaatagctgttgctgtaaacctccgcactgcaaaacacacacatcctagataattaaaagacaacttctaccagatgttgaagggcacatcattccaatcttatgtaaattattccagagaatagacaaagaggaactattcctccaacagattttaggaagccaaaataaccttaataccaacactagtggaaaacagagtaagaaaggcacaacatgatttatatgaggaaatcctaaacaaagtattagcaaattgaatccaacgaaaaatatacttgaattgtgtgcacacatacgaaatcattcttcaattaacaaatatttttaagcatctgacgtatgccaagcagcaacataacaccttgagacgtcagagatctttgcccttgtaaacctacattccagcagaagaaaatagagaatctataaataatagagacttcctagtgtcatccttgactgaggcaatctttttcttggtgctgcctaaaaacgcctttgttttttaaaaattgtatattattgatgactcatactagcttatagttaaaaggaattccccaacctttagaaaagtatataaatcattataaggaccagtttacttattatgatgtatgttgagtgttcaaaacagcaaaaaagagtaaaataataaataccacatccacccacagcttataaaagaaaactctgcccattctcctgtatatttctctgtgctgtttctttcttgccacatagggttaccactaacctacattgttttccatttttattgcacgcttatatgtatttttaagcaatagaagctattgtttacaggttttagaactttattaaatacgtttatggacagtaactaattccatttgtttaaacggtttggcataaaatagtaaataattcacagctagtaaaaccaaaaaacaaagagataacaactatttgctgcttacaaggaacaaataaaataaaaaactttaaatatttaattgaaatcacaaccatcctgatataataaacatactagctgtaagacagagtggtcatgctggacagcatcttcaagaaaccctccctgtggtttttatttgatccccataacatctattttaaatcttcttaatggctttcaataacaacttataattatatttgtaaagatcaggctcacttttttaacagattgctaagtctcatataattcattagggcaaattatattgtttccaacagttcatttttctgttgttgctggtgatttctattgatgtaatgaatttctataccgatttatatccagctatcttccaaaactctcttgtattaattctaataattattttgtagattatcttgggtttttctaaagatataattacattttctgcaaaaactaatagtcatgtttctttataatttttataaattttacttcctagtctattcttattggatgaccattacttctatttaaatgttgagcagaagcagtgcaagaaggcattcttttttttttttttttttttttgagacggagtctccctgtgtagctcaggctggagctcaggctggagggcagtggcgtcgcgatctcggctcactgcaagctccgcctcccgggttcacgccattctcctccctcagcctcctgagtagctgggactacaggcgcccgccaccacgcccagctaatgcttttttgtatttttagtagagacggggtttcaccgtgttagccaggatggtctcgatctcctgacctcgtgatccacccaccttggcctcccaaagtgctgggattacaggtgtgagccaccgcgcccggccaaggaggcattcttgtgttattccagattttaaaaagaacactgctaatagttcagttttaagtacatttgttacaaattttatcaggttaagaaattccctttattatattaccaataattgttctcatacaagttatttttatttccgctgattttacagatttggaaagtgaggcgtacacaggctaaataacttgcttaatgaaacactggtcacagagtcagaatgtgaagaacaggttgtaggactgcaaagctcttgctgggactgtggtcgtaggcttgctctccgctttgggccccactacgtgattaaaaatgaaggcttaggatatgtttacttggcaaatatcaacaggaagcagttggagcaatataaatttcagacaaagtaaaatgaagccaacagcattaaaatgagacaaagagggtcattttatgttatcaaaagttatggctcagaatggtataaattatgaattgtagcatatcatcaagctatcagacaaatacatggaaattaagagaaacaaaactctgtaggagattttaacatttctacctcaccctttaacagaattaaaataataaagaataaataatgacacaaattatttgaataccataattaatacattaatgttatatatcattttctcttggacatctcaagtattaacaccattaacaccccaaatacaatctcaataaattccccaaatcaaaaattatacatatatttctttccataaagcaataaatctagaagttaataaatttttaaacaaaatagtttgtctaagaaattttttaaaaatcactcttttaaagaactattgtgtctgggtgcagtggctcaggcctataatcccagcactttggggggccgaggtgggcggatcacttgaggccaggagttcgagaccagcctggccaacatggtgaaaccctgtctttaataaaaatacaaaacttagccaggcatagtggcggacagctgtaatcccagctactcgagaggctgaggcaggagaatcatttgaacccgagaggcagaggttgaagtgagctgagatcacaccactgcattccagcttgagcaacaagagtgaaactccatctcaaaaacaaaaaacaaaaaacaaaaaaactattgtttcaaaaatgaaataaaaactatagttggtctttcaaaaaacaatatgtttcagaacactaaaatttatagactatagatacattgtaatttaaaaaatttacaagcattagtgattttgtcattaagcaataaagaattaatatttcatgaactaaactttatattcaaaaagtttaaagaatcagcaaagctaaagagataagaaagataaagaaaagaagaacaataaattatggagaaaagcaatagagtgtatagggttaaaaactggttgtttgactctcaataaacttggtagtgatggaatgtatctcaaaataataagagctatttatgacaaacccacagacaatatactgaatgggcaaaagctggaagtattccgtttgaaaaccggcacaatacaaggataccctctctcacctctcctattcagtatagaattggaagttctggccagggcaatcaggcaagagaaagaaataaagggtatttaaataggaagagaggaagtcaatttgtctgtgtttatagatggcatgattgtatatttagaaaaccccatcatctcagagcaaaatttccttaagctgataagcaatttcagcaaagtctcaggatagaaaatcaatgtgcaaaaatcacaagcattcctgtacaccaataatagacaaacagaaagccaaatcatgagtgaatgcccattcacaattgctacagatacctgggaatccaacttacaagggatgtgaaggacctcttaatggagaactacaaactactgttcaaggaaataagagaggacacaaacaaatggaaaaacattccatgttcatggataggaagaatcaatatcatgaaaatggccatactgcccaaagtaatttatagattcaatgctatccccatcaagctaccattgactttcttcacagaattagaaaaaaactactttaaattccatatggaaccaaaaaggagcccatatagccaagacaatcctaagcaaaaagaacaaagctggaggcatcatgctacctgacttcaaactacactacaaagctacagtaaccaaaacagcgtggtaccaaaacagatatatagaccaatggaacagaacagaagcctcagaaataacaccaaacatctacaaccatctaatctttgacaaatctgacaaaaacaagcaatggggaaaggattccctatttaataaaaggtgttgggaatactggctaatggctagccagtacttcttccttgcactttatacaaaaattaactcaagatggattaaagacttaaacataagacctaaagccataaaaactctagaagaaaatctatgcaataccattcaggacataggcatgggcaaagacttcatgactaaaacaccaaaagcaatggcaacaaaagccaaaattgacaaatgggatctaattaaagtaaagggcttctgcacagcaaaagaaactatcatcagagtgaacaggcaacctacagaatgggagaaaatttttgcaatctatccacctgacagagggctaatatccagaatctatgaagaatttaaacaaatttacaagaaaaaacaactccatcaaaaagtgggtgaaggatatgaacagacacttctcaaaagaagacatttatgtggccaataaacatatgaaaaaaaactcatcaacactggtcattagagaaatgcaaatcaaaaccacaatgagataccatctcatgccagttagaatggcgatcattaaaaagtcaggaaacaacagatactggagaggacgtggagaaaaaggaatgcttttacactgttgatgggagtgtaaattagttcaaccattgtggaagacagtgtggtgattcctcaaggatctagaaccagaaataccatttgacccagcaatcccattactgggtatatacccaaatgattataaatcattctactgtaaagacatatgcacatgtatgtttattgcagcaccactcacaatagtaaagacttggaaccaacccaatgcccatcaatgatggactggataaagaaaatgtggcacatgtacaccctggaatacaatgtagccataaaaaaggatgagttcctgtcctttgcagggacatgaatgaaactggaaaccatcattctcagcaaactaacacaggaacagaaaaccaaacacagcatattctcactcataagtgggagttgaacaatgagaacacatggacacagggagtggaacatcacacaccggggcctgtcggtggggtggggagctagggaaggaattgcattaggagaaatacctaatgtagatgacgggttgatgggtgcagcaaaccaccatggcacgtgtatacctatgtaacaaacctgcacattctgcacatatatcccaatacttaaagtataacttaaaaaactggttatttgagaaaaacatgaaatagacaaatatctataaattataataaaaggaaatacaaatttacaaaatgagaattgaaaaggcaaaaagaggcacaaagtagaaatacaaaacaccaatgaaaagtggaaaatatgctcactagtaagcaaaatatagacactaaagtactgttcttcactattaatataagaaattctggctgggcatggtggcccaagcctgtcatcccagcactttaggaggctaaggtgggcagatcacgaggtcaggaggtcaagaccagcctgaacaacgtggtgaaaccccgcctctattaaaaattacaaaaattagccgggtgtggtggtgggtgcctgtaatcccagctactcaggaggctaatgcaggagaattgcttgaacctgggaggcagaggttgcagtgagtggagatcacaccatcgcactccagcctgggtgacagagcaagtctccatctcgaaaaaaaaaagaagtgtttataataatactgaattcaagatcatagtaacgtgtctgttttttacatggcagctagaagttggcacatcatttcccaaaaggtagcttttaaaaagtcacacattttgactcaatatgaatctaacccaaataaaaaattaaaatatcccaagacttttgcacaagatccaattttaattttttatttataaatgaaaattaggaataaatcattatgtacaataatagaataattgaaaattaaatgagataaaaccacatgatagaatttttagaatatgactgatgcaggaaaatgcttactaaatagtttttagtgaaggaaaaagtaggacacacctgctttttacagtatgtacagtagactcatggcatttaacattgtaacctttgattacttaacattgggtggtttgtgatggacctctgtgatctatggtgaataatatgttttcatttggagagagagcatataaaagattacagatcatttcctagtcaatgtttatatatatgtctcatacataacaacttatttgttttataaagctctataaaggcattcctaaattctttgatatgagaatactcaacagatatgagtatttgacatattttgtttttcctacagaacatcatcatccaaatccccttttcccctccctgactccaaatatttattagaacctgcagcataggagtgggtgtgctgggctggatacagaacattaggctgacagattttgactgtcagttaatgtaggagatttctgatttgatctcacaatgtcccagcaccaagttagtgaggatgtggctgcttggggttcgggtaagcgagtgtcctggtagagcatactgttttaaagctcagcaactgtagaatgaaagaatgctccgaagctaagacctcttgactcattatgactaatacatctcagagctgtatcgtaaggcaaatcagttctttataaataattaacttgggtcaacctgaggtcagagataatttgaatgctacatgactaaatgtttcctaccatctagctagtcttgctgactccttgccaaaagctgtgggagcccacctcttgtatcagcgtgatctggatgtgagacatggagtcaaaggtgatcatgttggaaatgtaaggtttaatgactgccctgttggatctaggacttgcatggggcctgtcacccctttgttttggccagtttctcccatttggaaagggtgtatttacccaatgcctgcacccccattgtgtctaggaagtaactaacttgcttttgattttacaggttcataggcagaaaggacttgccttgtctcagatgagactttggacttggacttttgggttaatgctggaatgagctaagattgtgggggactgttggaagggcatgattgtgttttgaaatgtgaggacaagagatttgggaggggccaagtggggaatgacatagtttggctctgtgtccccacccaaatctcaccttgaattttaataatccccatgtgtcaagggcaggagcaggtggaggtaattaaatcatggaggtggtttccactatgctggtctcatgataatgagtgagtctcacaagatctgatggttttataaaggacagtttgcctgcacaagctctcttgtctacagccatgtaagacatgactttactcctccttcaccttctgccatgattgtgaggcctctccaaccatgtggaactgtgagtccatgaaatccccttttctttataaatttcccagtctcaggtatttcttcatagcagtatgaaaatggactaatacgcttctcttcccacttcaggcctcacttgaatgccatttcttccaaagagcctcctttgaccccccaagagaaattgtattcccttcttatgttcaagagttttcagtttcatcactggcatctcttatacatcttcattcggacttaaatgctcatagagtgaagaaaggatggacgtattgtgtttacttaatggttcccagttagttccatcttgggaatttgaagctgggagtagatatttgatctcttgattctgcttgtttgtaagagtctacagtgttagttttctggaaggcaaccctattgtttggggcaacaaaccactaggaaacattaggactgaaagaccaggtgaacttgagattactattgctgagtaggatcatagggtacactttagtattttgcttgtgcttttcttattatcaatttaatacaagttcatttaaaaatgtagaaagaatatacaatgtaaagaggaagaaaatacctcatataccttgtatccagaagcaaccaggtcatctcttagcattttcatttcctttccagctggtataaaagattttcagtactgagagagctcttagaattcctctcaggctcactctaagtcaggactctcatcttcctgtctgttatcctttctattacttcataataccttattttaaaaaattaaggaaattacaggttggaaaagataaaccaggctggaaatatggagagtatgaaaagtggtaaagaaaaacaaaccctttaacatctattttctcagcatcacagagagttgaacttgtatagagtttgaactcccctcaattagaacctatagataaataattacaaaattcaaaatccaaacataccacagcaaatcaaagcaaactaaatcactccaacagcctgccctcccacccaccaaagtgacctataagaattatctaccaaatttatactatatcttgattattaagtccttaagttaaaattactgcagacaaatttagttactttactttcctacatttacacaatatttcatgagcttataacaaacactttgattaaaactcaatggtcaatatgttagcgattttggacaaggtaattttaaaagatgtaggataatttaaagtgattatggtaaataaacatggattatacaaaaatttatttccacagcagtagtaattatagaataaaaaattagaaatagcaaaaatatttcacaataaaagcttggttaaattcctacatttcaataaaacatgatgtcattgactgttggatagtgatatggtttggctgtgtccccacccaaatctcatcttgagttcccatgtgttgtgggagggacctggtcggaggaaattgaatcacgggggcaagtcttcccgtgctgttctagtaatagtaaataaatcttgcaagatctgatggttttaaaaagaggagtttccatgcgcaagctttcttttttgcctgctgccatccgtgtgagatgtgacttgcttctccttgccttctaccctgatcatgaggcctacccagccatgtggaactctagtcagttaaacctctttcttttgtaaattgcccagtcactagtacgtctttatcagcagtgtgaaaacaggctaatacagtacattggtaccagtagatggggtgctgctgaaaagatacccaaaaatatggaagggactttaaaactgagtaacaggcagagtttggaacagtttggggggctcagaagaagatgggaaaatgtgggaaagtttggaactccctggaaacttgttgaatggcttagacagaaatgctgatagcgatatggacaataacgtccaggctgaggtggccccagatggagatgaggaacttgttgggaactggagcaaaagtgactcttgttatgttttagcaaagagactggtggcattttgcccctgccctagagatttgtggaaatttgaacttgagacagatgatttagggtatctggtagaagaaatttctaagcagcaaagcagtcaagaggtgacttgggtgctgttaaaggcattcagttttataagggaagcagagcataaaagcatgaaaaatttgcagtctgacaatgtgacagagaagaaaatcccattttttgaggagaacttcaagctggctgcagaaatgtgcttaagtaatgaggacctgaatgtaaatccccaaaacaatgaggaaaatatctccagggcatgtcagaggtcttcacagcagcccctcccattacaggcctgaaggcctaggagggaaaagtggttctgtgggctgggcccagtgttcccatgttgtgtgcagcctaggaacttggtgccctgcttccttgccattccagccatgcctgaaaggggccaatgtagagctcaggccacaacttcagaggtgcaagccccaagccttggcagcttccatgtgatgttgagcctgtgagtgcatagaagtcaagaactgaggtttgggaatctccacctagatttcagatgtatgaaatgcctggatgtccaggcagaagtttgctgcaggggcagggccctcatggagaacttctgctagggcagtgtggaagggaaatgtttggttggaggccccacccagaatccctactggggcactgcctagtggagctgtgacacaagggccaccatcctccagaccccagaatggtagattcactgacagcttgcaccatgcacctagaaaagctgcagatactcaaccccagcccatgaaagcagccaggagggaggctgtaccctgcaaagccacaggactagagctgcccaagataggaacccacctcttacgtcagtgtgacctggatgtgagacatgaagtcaaaggagctcattctggaactttaatatttgactgccctgctggattttggactttcatggggcctgtaatcccttcgttttggcaaatttcttccatttgaaatggctgtatttacccaatgcctgtacccccattgtatctagaaagtaactaacttgcttttgattttaaagatcatagacagaagggtcttgctttgtctcagatgagactttggactgtggactttttagttaatgctgaaatgagttaagacttgggggactgttgggaaggcatgattggtttttgaaatgtgaggacatgagatttgggaggggccaggggtggaatgataaggtttggctttgtcttcactgaaatctcatcttgagttcccacatgttttgggagggaccaggtgggaggtaattgaatcataggggcaggtctttcctgttctattctcatgatagtgaatatgtctcacaagatctgatggttttaaatccctgcacaagtttttttttttttgcctgctgccatccatgtaagatgtgacttgcttctccttgccttctgccatgattgtgaagcctcccaagccacatgaaactgtaagtccattaaacctcttttgtaactttcccagtctcaggtatgtctttatcagcagcatgaaaacaagactaatacagatatcatgggactatgatcacaatatttgaactaaaaagctattgtcaaatactataagcaatattattctatttgtggaaaaatatattaacacttggaaaagagactgaaagaatattgatcaaaatctaaagcaggtttatttgtgggttatgagatctggtgacttaatatttttatttgtgctttttaatatttcccaaattttctacaatgagtatagattgttcagtagattgttctgaacataaataagacagattatctgtgtgaaaaatattagaatatttatggagaacaatctacataaacagattgtagattgtagaattattaacctagagtatttgggctcctcgaatgcccataaatgggtgtcaaagagtctgtgtaccctgtggaataatttgtatgtgtttgtatatattgttgctgatggaaggggatccacatctttcacaaaattctcaaagtgctctgtgatcctcaagacctaagcaaaagtactttgcagcaacctgttctaaatcttgtttatgacaatttaaagtcggtgtctctaggctcctcatttcaaagattgtgcatatataaactgttttggctcatgggccattcacagtgaaagcatttgggttaaagccagaatatttatgggagtaaataaaattagtatccacttgaaatgacagcagaaaaggtaagttattttttgtttgataagaactgtatcttactaccaaaactctctaatacatcctgaattattcaaaattaagactcaaattttcacattaaagttgactagtgtaatgatgtgtttctgttaaaaatcctcattatgaaatacattttgaaacattacctactgaataaacattcaactttgctttcttttgatccctacttaaatcaccatataacactgacgtcttactctgtaagtcttcacatggtctttgatcaaaagcagcgtaacctgaaaatgacctttataaatggacttacattttcctcttgtgaatggagatagagaggggctgaaagctgctctgtgcttctttgcctaacaagcctaaaaatcttatgggaaaaatgtcaacatcacccagacatttgaaaccctgaagggcattggtttgtcatttattcaaaaattaagttttctttcattttgcctttacactttcattttggataattgtgcacataaacttacacacacttctttcattcattaactgaagaattgcactctggttacaaagaccacatcataagtacttactaagttataagttaaaaagaagtggattcatttttaatttattattcaataaaattcttatttcccatttgggacagatgcagaatttgtggttcttttaaaatagcagcctgcaggcttatttctatccagagaacagtacagtccttttgagtttgaccctataaaatgttttgcttatttactttttaatttcagggttgatcgttgcagtcattacacacactggttcatggtgaacattggaagcttgcctccatattctctgaccaaagaagccacgtagtggttctcccttttaaaaaagttctttacaatcagctgcagccagtttttgattttggagaactttatctagaactgtgacattttgtggagttttatacattggaatgtcctgttcactaacccattgataggagaggggtgcgacccccttgctgcaactcactcactgcttctcatttggtgattgatcaagttctaccatatagactactgaagttttcattatgaactgtcaactcttaaggataaagagcattgttccaaaagacatctttttaagaactaggaagagtgggaagaatattagcctcctccaagtcaataataaggattcttattagaggattctgatgaggccacttacacatgtatagaaagacagggccaggtgtggtggcttacgcctgtaatcccagcactttgggaggccgaggcaggcagattacttgaggtcaggagttcaaggccagcctagtcaacatggtgaaatcccatctctactaaaaatacaaaaagtagccgggcatggtggcaggcacctataatcccagttaccagggaggctgaggcaggaaaattgctggaacccaggagacggaggttgcagtgaagccaatgtactccagcctgggcaacaagaacaaaactccgtctcaaaaaacaaaaagaaagacaaaaatcaaggatctacaacatatggaagaagaaggggttccctgaagatacatctggtaatttcactatgttttgcaggccaagacttaatagtgaaaataattcaacttttcagcttaaaaacaaaaaacaaaaaaacaattttctcctaaacatgtaactattgaaaaatctaagatacagggaatcagaagcaatgtatgagagaaggcatatgtttggttaatgtgtttcattatatgttaaatgtagttccccactactgatgttcaatagataaaaaataagcaaaatgtgtgaaataaagtgctattatagaatagtgcaaaaactttccaatggtaggctcttgtctcttttctatagacttgtgatctgtggggatgtgctctcatgctcttcattaataccctgctccaccccatcgttaaatattccagacttttctaagtaaataccatccaacaacagaatacgcatctttcattgtcacagttagctgatatctatggaacgctccacatttctccataacttcaatactgaagcatgtgcctattcgtcattctttttgccaacccagtgacttcaacactactcttggttttcttggttttccttctctggcttacccctatgatcgttacaaaaaccacggtttccatctccattccaatttagccactatgtttatagccataatttaaatctaatcatcagtcaagattactttattgctaacatcctaaattctaacatttcctttttttcttccacaaagttttgttttactgctccattcattttcttaactttactaatcaaatagttatccttcttttctacttcagttccttattgctcctctgattttccaatccagtggcactcaagctttggcatacattagaatcacttgttgaaacacaagtgtagatcgtaccctccagagtttctgattctgtaggtctgagatggggcctgaggatctgcattttaacgggttccgagtgatactgatgctgctggtatgaaaaccacactgagaaaaataatctttgttcaataaaactcttgttccattagagaaataagtgattgggaagtggaacttacaagggtggttcaacatatacaactcaatcaatgggctacatcatatcaacagaatgaaaaacaaaaaccatatgatcatttcaattgatgctgaaaaagcattctctatctcgtctgttttttatatcatccatcttttaaattttggggaacctattgggtaaaaaataatatcttactctttaaactggtatagtatttttttctatcatgactcatgtggctaagcatgtttttcatatttgttgtttgtttgcctttcatttatgtgaattgactactgaactcatttctgtttatttctttctcagtgagtgataggaatttttatacattctggttgctaattcttcatttgttattatacaacacaattttattagtctttcacttgtgtttcaaccatgaataagtattttttatatattttaattattttaatataatcaaggttatctattttttttacactaccatttttgggtttttatcctagttagcagggccttccttatcctggggtcattaacgaatattagacctcttttcttttctttctttccttcttttctttttctttctttttctttctttctcttctttctttctctctctttctttctttttcctttcttccttcctttttccttcccttctttctccttcctttctctctctctttttctctcctctctttctctctttgtttcttctttcttcttttttctttgagacagagtctcactctgtcacccacgctggagtgcagtggtgcgatcttgggtcactgcaacttctacctcctgggttcaagctattctcatgcctcaacctcccaagtagctgggattacaggcatgcgccaccatgtctgtctaaactaaatcttttcctgatgcttttaaagatttaaaaattttttgctctactttttaaactttccgaaattattttttctgtatactatgatgtaaaaaatctaattttaattttgtccttattaatagtccatcttttatttatttccagtgctacccctctcatagaccaatacccattatatgtgagtttattctatttgattggacaatttacctaatatggcaccaatgctacactattactatagctttattaaatgttttgatatctggtagaacaagttctcccatttacttatttttcacaaatttctttttttttaaatgatagcaagtttattaagaaagcagaggaataaaagaataggcaaagcagccacaaatttcttatattctcttgtaacttacttctctgtgtaacttttagaatagacttgtaaagttccacgaaaaatcttgttgagacttttgtttgatattgtgttgaattcatgcattagtttagaggaaattcacatctttaaaagtgtggattttctcacctacacacatcttaacctctccacctattccagtgttcttttatgcccatcaggaatgctgtatcattgaatccacaaagatttaaccctcttgtcattgttaaatttattcctagatacttaagatttaactgaaaaagaaaacattcctttaacgtcaatcctctctcttgatctaatcctgacactctaatttcttaaactgtccattttttgaatgacctgtttggagagtctgttttctccattttcataccacctgctatattcccttgcaatatggctttctttcctgacactgtagaaaaagtattctttaaaatgttgctgatgatacctgaattgcctaattgcataattttttctcagttttaatcattctcaatttctctgcgttacttgtcgttattgatccctgcacctatgtcaatactcctccattgctgtccatggcatttcactgtcctgttttttttttttttcctattacactctcattgcttcttatctagctttttattctcccactctgtgaacatactgttgttgtgacctctttctatatgctttcttcccatgcatttgaggatgacagggatttctatatgctcccaacaatgattttcgtgcttggcaggttatgggtggtgaataaaggtttcttgaacaaacggatcaacctaatcatagctttcaaatgcttattaacaggaaagtcaggtcactattgattattgggcaaatttgaactctgtttaccatttctgaggctacattatggtctcattttactttcagtcgtatttttctcctccactgtaatcaaactgttaactgcttcataatattgcctttgttcctgaggttttctctacctgggattccttccacttttatttgttgaactcttgtccattacttaagaactatatcatctctctccttttcttggaagtcttttctcattcttcctggtttgatgtaatctcttccacttttgaatcttcagagacactgtctgatttctgctactctcattgcatttgtattcattaataataaaaactgtctttaaaattggcacagattaaaaagaacgataattcccaatcttggcaaggtgagggaagagaaagtttcaaaaattcttgataggaatttctagagcataatttggcaacatgtgtcaaagccttaaatatgcaattagtccatggtgcagcaatttccatttccatgaatttttcctaaggaaatagtcaaagatatgtgcaatattgctcattataacatgtttttgtaaaagtaaaaaaacctgtaaaaacctgtgtccaataatctagttttggctcagcaaaccttagcatatctataatagaagacaacaaaaccaaaatcattttataaaagaatatttatttacatgggaaaatgttcacaatatgaaaaataaaacaggacatacaacaatttttctagcataatgtcattatttcagaggaaaataaatgtgcttagaaaatattagaaagacatttaaaatgctattaatggttttgtgagattgtggttgatacgaatttttttaaagttctacttttctatcttttcaaaattttcatatgtgtgcattttgtttataatttatatccaaatggactacatgatatgttgcccaggttcctcctcctctcttctctaccctcatctattaagacgtaggctctcattcacctgctgctggaggactgaaggctgacctccccgtgttgagacccagttctccaatccagcaactgcccttcactgagcaaagctgccactggagagagttgcctcttccaaggtcacatgcccttcccacaggaagtctgcatctagtgactgtagttataggactctaaactcctatcccctttaccccaatttgagagaatgctacagggccatccagcttcagatttcactctgcaattagttgtgggctttcttaaaacttcttcacgacccaccttctccctctgtctgatcatggttctttccttccccctacagctgtcaatcctgagagcccaccctagtaaacttcctacatctgctttacagggaagctcacctggaacatctgtttgcttggcactttacacttattacctcccaaaaccttgcaataggattttagggcagttattggcgtctctgtttttcagaagaagaaaactacattcaaaatgtttatgtattttatgcaaaggtacactattaataaatgtcagagccaggtttgaaagtagctgtgtttggatataaaaactatgctttttccattaagccaaatggctctctgcagtcagttgtgtgctttattatttttgtgcttttctagttctctctggtagatggtaaattcgttggctgcagggattttatcttatttgtctttgaatcccctgcagggtattgcatagtaccttacacataataagtgctccatgtttttagaattgacttgaactagttgaggcttgaaatgtagttctacttctgttccacaaaaaaacagattccctagcaggaaaagaaaatcatgatggtaagatttagaaattgttttttgatttaaatttcatgaaataatctcctaaaaaagagtgatactaattttcttctctttgcttaatattagataacaaaatgcaattttccagaactttgcttataattactaaaataaacaaatcagtgagtgtaataaacttatactgaactgtgatggcaaatactatggtttttaccttatatccctgattcagggttctctgaaatctaagtcattggagaagagaatctactaagagtagaaaaatgtaacaaggaaataagcttgctccttacacaagaattgaaagtattctaagagtcttaaagtttttgtggcagcagagatgcgtgagctgacatttccagcaatcaatggaatttgcaagtgcgagatgaattttccttaattaaaatctaccagattaatcatattttaagtacaagtaaaatgaatgtataactaattagttatgctgttaggaataaatgacattaggttcatgtttacatttagggaggcagacatttgaaagtaaactacaaagactgctgctatggtctgaatatgggtgttctcacaaatttatgcattagaacttaattcccaacatgatagtattaagagatagggcctttgggaagcaattaagtcataaaggctttgctgtcgaatgggattagtgctcttatggacagttgaagggagttgcctcaccccttccactctgtgaagacacatagaagctgctattatgagcaacaagccctccccagacactgaatctgctggctccttgatcttggacttcccagactccagaactatgagatataatttctgttgttgataaattacctagtctgggatattttgctgtagcagcctcaacagaccaagacaaacacagagtagagaaactttccatattgactgagttttattgttcttgcactccagagaatcaacatgaaaggatatgtctaacaccaaataggggttaattagttgaagttattaaagccagaaggccctggcaaatggcataacatagctacagcatgcatggttggtaactgacccaaattatgctataaaaatggtcaatgctacagcctggatattctcctagtggataaaatatgaagccacctaggtgagatgattttaggtgccaccacactgagtgggtcaaacaccatgagtcctagaattctactgttagaaatttatcactttggttgaccactttagctcctattacaatatgtatttcccagagaagctaatactcatcagttccttaacacagatatgccttttattgaaaaaaaaaaaaaacctacagaaatagaggtctggaagcaagaaatatagtttcaaaaatcaaatgggacaggccataattataattgcatatggttatgatcaatgctgaaccttaagcctgagacctaaaatcaatctagctttcagtcaacttactttagtctgtctcatcatattatttccttttatattagcctgttctagaagttctgtaaacatttccttgaaaaggtaagcaaccatctctaaggctagaagatcaatctcattgattatatttttccctgaactctagttcttccttttcagcagaaatattactgtccttagtggctcaagcctgtaatcctagcactttgggaggctgaagtgggtggatcacctgaggtcaggagttcaagagcagcatggccaacatggcaaaaccctgtctctattaaaaatacaaaaattagccaggcgtggtgttgtgcacctgtaatcccagctgctcatgaggctgagtcaggagaaacgcttgaatccgggaggcagaggttaccgtgagctgagatcatgccactgcactccagcctaggcggcagagcgagacttcatctcaaagaaaaaaaaaaaaaaagaaatattactgtcctagaagaaaacctctttaactcttatttctttcccctctattataaagtgccaataaaaaaggcttccagagcatataggtatttatattaaaacaattaaaactactgtttatctattaactccatatattttcaaaagaccactattaggttacccgcattctgtccataggcccatcctgatagaggctttccttccagttctaaggtgagattaatgtcttcttgaaaatgcttagaaattttgaagtttctgttttcagttgaaatttctcaaattgataaaccttttcaactaataattatattagtttgttttcatgctgctgataaaggcatacctgagactgggaagaaatcagaggtttaatggacttacagttccatatggctggggaggcctcataatcatggtggaaggcaaggaggagcaagtcacatcttacgcggatggcggcaggcaaagagagaggttgtgtagggaaactcccatttttaaagccatcagatctcatgagactcattcactatcatgagaacagtgaaggaaagaccttcccccataattcaatcacctcccaccgggttccttccatgacatgtgggaattgtgggagttacaattcaaggtgagatttgggtggggacacagccaaaccatatcaataatcattccttttaaaattgcaaataccatcagtaaagtcaattgtaactctttgttataatttacatttacaaatatgttgtattaatattagaaattataagttatattaatatttataaatatgtttgtttacatttattctgttacagttgactactgatggtatttgcaattttaccatttgtaacatagagtcatttgtaaattaatacaaactattttaagcctttgatttcttttaattcctaccttagggcattcactgaaagaatgagattaacttgagggaaagggagaacacagagaatggggtggtaaaaagatattgctataaaagtctttgggtagcagaaaaagactagcattggggcataggaaaagacatggggtagtgacagacaagtgtttgtatcgaaattctgccttaggtggattttgattaggatgggagagagaaagagtgagaatgagaataagaatcacacacgcgtgcgcacacacacacacgcacacacacacgcagagcaagctctttgttacttcatttctgccttctttctatcttcacccaagacaagtgtcttttttgctatgcgaggacttaaactaggcttttttaaaccgaatttgagctatactctgggctaattgattcttgcaagctagtctggcatttatggtgcctgcttttgagaaaagatgcctttgcaaatctgaacaataagcacttaggaagcctcttacaacaaattgacttataaatcaggcacacagttacagatagcgttttaacaagagaaagcacctactaaagaagtcagctgcccatcagatgatgtgaaataaatgtttcttattgagcaagtagaaaagaatggtgagctcgttcattttacagtcagaccatccccatgtggcagggtgggccaactaaagagggaaatgtgagccgttaaatatttagtaattatttggtgtataaaaactctagccatggaaatagcttatccacttaaaattgtaagtatattttgtaggaattttaatgatgtgtatgcattttgggatcaaaagatacatatagaaaataaaatgaaacaataaacacattgttcaacacactcagaaaagctacttggcaccattttaaaaaaatatatgttacgttcattttgcctttggctccttcatcttgttcccttgtcaattacctgtccctctccaaatagcccttttctctttccctattcttagaaggctcttttccctaagataattcagcactctctttcctcactcctgtatctttctagggagtatggtgtacagggtgatgtttttctctgctcaagtcattaactttgttagaagagcaccagacagagtcagtaggattcttcccttctcagtattaactaagcacctgtcaaggttatgttttcaggcaaagtttatggttggtacacagagggttagaaccttaaccatgacattatggagcacatggaacctgaaacttctgaaggaaactttccacttcagcttttggcaagaaaaataagacggagagaagagagggaattagatcatgacacatgttactcagagaaaaaaaaaagcaggaggtagtttaagaaaatggggtgaaggaaagcctaagagacaaaattctggcatcactttcctacctaggaaagtgctctcttctttcttatatctggcttctaagctaattttttaattattcttactgcctctatgttcctcaatacttcatttttaatgaaacacatgtttaaggtcattttcattatttatttttctagggagttctttctccaacttcagaactctctctaatattcttgtggttattcagtcttctttgatttttaagggattgtcaaggttcctgaagcaatgtattttcttgttcagcacagttttcagctgtgctcaatatttggattattcaaaagagagtattttgttttccttctggcgtgattcaaagtatgtagagtagtcccctcttatctgcagagtatacgtgccaagactcctgtggatgcctgaaaccacagagagtacctcactctccatcgacactatgactttttgatctgataactgagacaactactaagtgactaaccggtgtgtggtgtacatggcgtggatccactggacaaagggaggaatcatgtcccaggcaggatgcagtgagatggcatgaggtttcattacacaactcagaatggcgtgcaatggaaaaacgtatgaactgtttatttctggaattttccatttactttttcagactctggttgactgaaggtaactaaaaccacagaaagtgaaagcgcagatggggagggggaactaatgtataactatactttaataacacaaaaattaatgatgtagtatatttgctaagcaaatctggcaacaagaaggaagatggaaaacctcagcatcctgaagagtagttatttatctcagaatgaaattaaattttcaagagggtgggaaattatattccaacgataggatgaagagcagaaggagggttaatgtatgctaatattttagggaatatgagatatatgaatttgggtaagcttttttgttttccctttatcgtaggagaaaataatgttgtgtatgcattgaaaaatgcccattgaaaccatattttacgtaagatgtatacaatgctgacaaagattagtttattaatttataatgagtagaactttcatggaattacaagataaaacactatttctggtaaaaaggcagaattaagtaaagtaaaaaaattatctttacattttataaatggtcttggaattcagaaacttggtatatgtaaagtaaaagaaaaacagaactgcatgttggaaagaaattctctaatataaactgtaaaataaggaagattgttttttaaaatcctggattaaattacattttgataaaatatttgactttttcaaatgatgctggtatctgcttccatctaaagacagcatatgcttcagcttgaaacacatctatttctgttattagattctccttttaccataattgttcttgtttaaatcaccatttacctaccttttcatcacgactttaaaaattcctgtattgattcaatattatgatatgagaccttttaaagaagtatcttttttatagaaaaaaaatctgcttatttggaaaatgtgtaaaatgatggaagaggatactagttagtcatcaaaacatatttcctcttcttaattagcacacagttatgccacatttccaagtctcccttgcagtaaggtgcagccatgtgactgagttctagccagtgaaatgtaagcagaagagatatatgttatttccaggcctggctcataaaatgcaccctacatgttctctttcctgcaactttcttccttcaactgattgtggtggaaacaacaatacaaactttggaagcctcattttgagggtgtcagaacattcatcagagatataaatatttttctgtaaggtatgaggtattatacatttttagagtcgttttatataagcttagcctagagttattaataaactacctcaagataaataccaaaatacaacaatatccaattttatataataaacaatctttctgttaaaacattctctttataaatataatacaattctgttgactttgacattacttaatttcattatacttttgcctcactattaaaaccagatatcattagacttctctgataatttgtaggttgtctttctaaaattaaaccaatggtcaaagtagaattgtttccattatactgatatgaagcaataatgtaggttaagagctcagtaagaaggccagatatactgatattgaaaagcttacaggacagtctccatagcaacctcgtgcatattattttattagtttcttacaaaaaacgtatacctgaaaagtactatggaaatggtgaccccaaatgtctgactttcccaaggccacagttagaatgtaactgaacccagttagaacttgatattcttttgaaagctatgctaggaggctggataagtccacaggagaattcataatatcctgtctaattgccatatctatgcttgatttgggtaagaaaattctggaagagaacccattgacaaaaggcgtacagaacctatcaattaacactttgttaaaacctttaccttcctacataaaatcgtagacttttaaacatgaggatacatagaggccatttatttcaacatgcttgacaaaataagagctcaaaatctatctctgataagatgtagtttttctagttgtctatcttgcacatgaatatttacctgtgctaaaaagatagtccattccacttttagacaacactaattgttagaaattttaccttatgttaattgaaatctacctccctgggactttaaatgctcaaaggcaatcagattttcctttactgtagcttttttttttgtatttttttaaattttattattattatactttaagttttagggtacatgtgcacaacgtgcaggtttgttacatatgtttactgtagttttactctgctgtgcttcaaatcctttctgaccacatttgttgtacccttttcaatttgaagatgaatctccttgggagagaagaaagaagcaaaatcaaaattgagtggctttactttctctctgtcattgaataacatcttcttcaagcaggagggctatttttttcttattatccttattcgcacatagctttttaaaaagtttgctgttcccagtactcttcaataggtcaaggagtctccaaatatttgtgcacggccattattttggtatcttaagaaaataaaatgactcctctttcatcttctttgagtgatagggttattctttcaatcgcagcaaccagcaatgcttaattgtttgtttgtttgttttttaagtcacactaaacttgaacatgacctgtaactcattttagtggcatcaaattactatctcatgacaagtagtgcaaatgcatttgtgtcctatgcttaccaggcactgtaattcagcccatgctgaatgagctttaggagaaattcatatcctgaccctggtactgtctaaaaactcagtgcctttggcattcatatttatatctcttgaggatgctgatcattaggcacatgtatattttatgacttattgtaattgttgcttcaaacttttcttcacgtgctagaagcttatatatgtagcatttttccctttaattaactagatctcaaattatgttctctttacaggtcgagaacgcattcatcacaatacaagacctgggcaccatttgtattaaacttgcacttagccgtatctgatttaatttccaattcttaataggtatattagcttatatatgaaacacaaggcatgcctaaaacacaaagcatggcatatatagctttgaattgccctgatcaaatagctaatgatctgacactaattctcatatttctttttaaccatggctattttgttttccatttaatatataggaaatgaaaatttgcatttgtatctcagtagatggtttaaaattgactttcatatacatcaaatcctccccaaaccctgtaatataagcagggttggtattgctgacttcaaatcctccccaaaccgtgtgatataagcagggttggtattgctgacttctgtgtttagaaagaaaccaaagcttaaaaactgaaagataaaataaatgaacgaggactctccatcaatcctgttgaaagattttctattattataatagtaattagcactgaaataacactattttcaaggaccattctaagtgctttacatatattaactcatttcttcacaacaatctatgatgtaggttctattattgttattcttattttacagatagagaaactggggcacaaagtcacactgctattaagaactgagttttgaaccaaactattctgtctctagagtccatagccttatttcccatattttcaccttggtaaacatttatcgagaacatgatctgtgcaaaatgctttgttatgtacactgagagctataacaactaacaacatgtttgaagggataaatatgactgtaactttaaaaactgaagctatcgtaaaaatattacagaagcttaaatgttttttcccattggtatgaggtgggaagaaagagccctagtggtcaatctaggaaaccatttgaaggagatatgatttgaagctctttgcaatctgagaagacctttgcagcgtgagaaggactgtgacaggtgggcacctgggcaagagcattgcaataggacagcctacgtagaggcccagggaatgagactgtgggagtgaaaggtgagatttctcatgtggttgaagttgagggtgtaggagtgaggcaggatttagtaacagataaattacgaacatagcctcgagccagattgtggagagccttgaacactaaactgagaagatttgaattccttctatatgcagtctggacccaggaaaggtttttaaggacacgagttacataatcagataaattttagaatggcatctctggcagcaaagtataggcttaattggagagggctggactagagaaaggagaaccagaattggataaagacacaattgtccaggcaagaaagaggcaatgagtgtctgaactaagctagtgaaaatatgagtcaggagccttttaccaaagagaaacttgctcagaaataggataaactagatttggaaactcatgggaaggagaaataggaggttacctcacattttatagtctgaacagtggagaagttgcccctgtagtcacaggagacaaatatatggtcagttttggggattttgtgaaaaagcccagcccatgataatctttcttcttgaattttaacactcagctttgcacagtttggtcctctgcttgtattatgtgtatctcagtgtgtgtgtgtgtgtgtgtgtgtgtgtgtgtgtgtatgtatatatatgttatatatgtgtaatatatatgttatatatgtataatatatatgttatatattatctggcatgtatatatacacacacacatacatctcatatcagatcatctctcataatgtcagtgtgtattgtagctttgactgcctggttaacacgtgaatctactcatcgctgtatcggaaatctctctgatagcccaaatcatctcttactattttcataggtcatgctatttttcctaaaacacaagttaatctttctctcttcttgaatatttaaatattgatataaatttgaatacaattggtaggtaagatcaagggttgggtgattttgatggatgataacaatctagtgaaagtatttttagacatacgagttatgatttttttgcataattcttgcggaagaccgtgtgatagttttctgtgtgtcataaattatttcaaaccctttgcagtttcagtatgaaatatttctaatgaacaactcctttgaattatactagcaacattctatgtggctatttcagaggataatatgtctacatttttgctgtatgtttttgtactcttaaccacatttaaaccattgttaaccttggaacatcctaagatctggccctgtattttttacatcttttaaagaggtgacacaccctttataatgtgcatttttcactttttaaacctaccatttactttttaagacattttgaacgtttatttcatcctattgtgatttttaatttttctccattatcgcttacaatgtttatatataatttatgataataatgtatatttgcaatgcatataattcacctttttgccaattgatcttcattaagtcagtcaacaagagaagcttaataatgttcatgtcctttaagatgctatttaccttcatggttcagtctataaaaattgggtccaagacaaaggaacacactccagattagtcagacaatcctagcaattgttttgtcaattctattattattcatatgttgcttacttttattgagtctttctctaccctttcctttctgagccctaaaataatacttgctgccccattgacttcaggcttggcaacacagctcgtttggccaatgaaatgtaagtagacataacatgttgctctttaagcagatctttgagttattgtctgatttcctccaacttttttgtcctatctttctgtaggctagcacatcacagatagaggctgcgacttcagccttgatctcaaaataaagtgcacctggagcagaacctcagtcaatatgtacccatacaatgtagtgaaatataaacctttgtttttgtgagttactgagacttggaacttatttgttaattgcactacatttagcttaaactaatgcaaataactttctgcatattttattcttgtttggtgtagatcattgtagacattttccctacatattttctgaaaaatttagtatatttttattaaatggtatagtattataaaataattgttgtaaactttaaaaagtctttattctggttaacagtgtattgtgagcattaaaccagatgactaaatgtatacttgcctctttaatgatttaatagtgttctgtttatggaaagtggcatagtgtagtggttaagagtacagtctctgggacataaatttctgggttcaagtcactgttctaccacttactagctgtgtgaccataagatactaaatttatttgtgaccttaagtaagagacttatttatcctatgaaatagtaatccaatcccttattttgttaaataaatgactttttctattataaaaatatggtaaataatatcatgggtgccaccctctccctcatcctcacttctggcttacctcaatttctcatgagcctttattattattacttttaaataactttcataactttttaatgattgccattctaactggagtgagatggtatctcattgtggttttgatttgcatttctctaatgaccagtgatgatgagctttttttcatatgtttgttggccacataaatggaaggggaacatcacaaacccagggcctgtcggtgggtcgggggaagggggagggagagcattaggacaaataccaaatgcatacggtgcttaaaatctagatgacgggttgataggtgcagcaaaccaccacagcacatgtatacctaacctgcacgttcagcacatgcatcccagaacttaaagtaaaattttaaaaaatgtatatatataaaataccttttatattcctctttatatctagtactaccacaactactttaataaaaaatattaatactttgatctcttacctgaagtgttagtctacttttatcactcttatcatactttaatctgctctccatactgtagccagaatgacttttccaaatcgtaaacctcatcattcattcatcttcttaaaactctccaatggtttccattttctcttagaataaaggaaaaatttcttaccaagtcttaattattttcttagtctggtctctgcccctccaccttcatattttccatattccatcatgctgtctgtgctccatttctgaaaaattacaaaaaagaaaaaaaatcaaattatatatattagattaatcaggactccatagaaaaacataagcaatagtatatagagtcatgcattacttaatgatggggatatgttctgagaaaggcattgttagatggtgtccttgtttgaagatcatagagagcgcttacacaaacctagatggtatagcctactacacgcctagactatatggtatagcctattgcttctaaactataaacctgtacaacatgttactttaccaaaccctgtgggcaattgtaacacaatgctaaatagttgtatatctcaatgcagaaaaggcatagtaaaaatacaatcttataatcttatgggaccactgtcctatatgcagtctgctgctgacctaaatgtcattatgtgatgcatgactgtgtatgtgtgtatgtctgtctctgtgtgtgtgtctgtcaaaagagatttattataagaaattagaaattggctcatgcaattatgaagggtgagaagtctcaggatctgcagctggtaagctggagacccaggagaggcagtgctatagttctagtctgagtccaaaggcctgagaaccaagaaaattgatgttgtaagttccagtccaagagcaagagaagattgatgtcccagcctgatcagtgaggcagagagggcaaattttctcttaccttgccttatgttctattcaggccttcaatggattggttgaggcccacccacattgagaagggccatctgttttacttagtctacggattaaaatatatgtcttaaccagtgcttgcttcggcagcacatatacaaatatatatcttgtccagaaacaccttcacagacatgcccagaataatgcttttcatttgtttttgtttcttattatttttaatttttgcaggtacatagtaagtgtatatatttatagagcatatggaatattttgataccagcatagaatgcataataatcacatcgggtaaatggggtatccatcacctcaagcatttatcctttctttgtgttgtagacaatccaataatagttatttttaaatgtgttatttaaaaattattattgactgtagtcaccctgttgtgctatcaaatactagagcttattcattctatctaattatatttttgtacccattaaccatccccactccacccaccactctcagcctctgataaccatcattctgttctctatctccatgagtttaattgttttatttttcagctcccacaaataagtgaaaacgtgtgatgtttgtcattctgtgcctggcttatttcacttaacataatgacctccagttccatccatattgttgcaaatgacaggatttcattcttttttgtggctgagcagcactcccttgagtatatgtaccacattttcttatccattcatctgttgatggacatttaggttgcttccctatcttatgaatagtgctactgttatggatagtgctacaatctatgtgggagtgcagatatctcttcgataaactgatttcctttcttttgggtatttacccagccgcaggattgctgaatcatatggcagttttattttagtttttttgaggaacctccatacttttttccatagtggctgcactcatgtacattcccaccaacagcatctaaatgttcccttttctccacatcctcatcagcatttgttattgcctgactttgaaataaaagccattttaaaactggcatgaaatgacatctcattgtagttttgatcgcatttctctgatgatcagtgattttgagcaccttttaatgtacctgtttgccatttgtatgtcttcttttgagaattgtctattcagatctttagcccattttaaatcagattattaaactttttcctatagagttgcttgagctccttatatattttggtgattactcccttgtcagatggaaagtttgcagatattttctctcattctgtgggttgtctcttcactttgttgtttgttacatttgctgtgcagaagctttttaacttgatgtgatctcatttgtccattttttgctgtggttgcctatgcttgtggtgtattactcaagaaatctttgcccagaataatgttctggagatattcccctacattttcttgtaggaatttcatagtttgaagtctcagatttaagtctttaatccattttgatttgatttttgtatatggtgagagataggggtctagtttaattcttttgcctatggatatccagttttcccagcaccatttattaaagagaatgttctttcaccagtgtatgttcttggcatctgtgtcaaaattgggttcactgaaggtatatgaatttatttctgggttgtctattctgttccattggtctatgtgtctgactttatgccagtacaatactgttttgcttactatagctctgtagtataattggaaatcgagtaatgtgattcctccagttttgttctttttgcttacatccagaataatgtttataaaatatctgggcaccaccagacacactaaaattaatgatcacagtatactaaatttggaatataataatttatattaggtctttgtcattatagaaaaaatttactgaaatgaacaattttggaggaagtataaattaccaaataaaagcaagaagaaataggaaacaaaaatctaacaatgtccatgaagaaaaattttttaatatttcaaataattacttcaaaaactagtcctaggatttaccagtgatttatttcatgtttaagaaactgaaaatttatttgccatttgtttttagaatattaaaaattacagaaagttatataatgtgtcttataaaaccaacataaatctgaggccaaaatctgacatagagagcaaaagaggacattccaatacctgtgaggataatcagaattttctctctctctctctctctttctgtgtgtgtgtgtgtgtgtgtgtgtgtgtgtatgcctagtttgaaaaagttttttcattcaggagattcctctatatatttattatcacaattaatgtgttcctgccttgtgaacagtggtttagaaatataaatatatattcaaaacctcaaaatactaataaataagatttaaaagtattttcaggcttccacttctttctaagagtgactaataagcactggatttactgtccaacctgaaacaattgaaaaaacagaaaaaaaaaaaaaaaagaaacaatggctttcaagacactggacatcagccagtgaagaccagtgttttagtttggtagggctgctatgtcaaaataccacaaaattggtggcttaagtaacaaaaatgtgttatctcccatttctggagactagaaatccaagatcaggttgtcggcaaggttgcttcctctgaggactgtgagaaagactctgccccatgcctctcacctagcctctggtgctttgctggcaatctttggtgctcactgatttctaggagcatcactctgatctctgctttcatcttcatatgatgttctctgtatgcgtctgtctccaaatgtctcttttttttttttaaagaacatccatcatattggattagaagcccaagctacgctagcatgaccttgttttaactgaactaattagtactgcaacaatcctatttctaaataaggtcacattgtgaactataggggttagaactgcaacaaaagaatgttaggggacacaattcaacccataattgatagtgatccctgtggattgagacattaactaaagaagtcctatgatggctccaagttacttcctgaagagaatttccttctcacagagcagaaagagaaaacctaagtgaaggtcagtgatctccctgacttgagacaaagctggaagtccacgtgggccaaggtggctagagtggtcaggacagagtcttagaaaggagacagtagcagaaagaggaaactccagagcttcctctgagttttcagctgagcgccgatcaaggtatgggtgtgaggaaagtaccccaggccacagaaagaaccattctgaatgactgaaggaaacagttcttgaagatctcacagggtcaggaattgttcctcttcccatcagccagaggagaaagccttcatacatggagcactggttaaagtacctagaagtgtttttccttagtgatggggaaagattagccttaaactaaacactgctgtgaccccacctaacaatgctttaaagcagaacctaaatggctcaaacattttataagtaacttctttaaatctcagaacaaagctcaagaatatttatagaaatacagaaacatatagcacccaaagaggcaaaattgaccagatctagcatccaataaaaaaaattaccatgcatgcaaaaaagcaggagaatccaacccacaattaggagaaaaatcaattgataccaacccagaatgacactgatgataaaattagtagacaaagacattaaaacaattattataactaaattccatatattccaaaaataacaggaagatttcacatgttatacagacatgtgaaaaacctaaggatctaaattgaacttctacagtgaaaaactacaatgactaattattaaaaataacatttatgggattaatggcaaattagactttgcagaaaataagataagcagacataaatcatagaaactataaaaaatgaagcatggagagtaacaaactaaaaatatatttgaagaaataatggtccaaacttttcaattttgacaaaactattaatattctaaaagaaaacataggagatttcttaattaggacacaaaaaatgtagtccatacaagaaaaaagaaatagattggactttctaaaaattaaaaacttatgttatttgaaaggaactattaggagaatgaaaagaaaagccactgactgggagaaaatatttgcaaatcacatattggataaaggaattgtatcaagaatatataaacaccaaactgggaaaaaggtccttgcaaaccaaaaatctgataaacagttaatatctaaaatttataaagaactcttacaacctcaatagcagaaaaacaaataactcgatttaaaagtgggcaaaggacctgactagacatttctccaaagaatacataaaaatggcccgcgagtaaatgaaaaagtgtgcaacatcactaatcatgaaggaaatgcaaattaaaaccactgtgagatatcaccctgtatccttaaggatagctattatcaaaaggtcaaaagataaatgttggtgtgggtgtggagaaaaaggaaccctagtacactgataggaggaatgtagattggtacagccattatgggaaacggtatggaggttcttaaagaaatttaaaatagagcgaccatatgacccagaaatccctctctgagtatacacgaaggagatgaaatcactacctcataaagacatctgcactcccatgttcattgcagcattattcacaatagctgagatatggaaacaatctaaatggccatcaatggatgaatggataaagacaatgtgaggcatatttaccacaacatgaacggacctgggggatgttaagctaagtgaagtaagccaaacacagaaaggaaaatattgcatgatctcacttatatgtggaattaaacgaaaacagagagctcaaatacacagagatagaagatgaaacagtggctaccatggtgggcagaggagagaggaaatgggaagattataggtcaaagggtacaaaatagcagacacgtaggataaagaagtcgagatctaacgtataacataaggactaaagttaacaaaattgtattgtattaaagatttttgttaagcaagtatattttagcagctcttgtcacaaaaaagtatgtgagatggtagatatgttgacagcaaatctacatatagacaccattagctttcctagcacaaataaaaacagaactatatgatgatctcagtatatgttaaaaagcatgaaacatttaataaaagtcaaaagctattctttaatttaaaaaactcttagaaattagtaaaaagaaaaaaagaaacattaacatcagaaagactatcagacaacatattccctgctagtgaaacactaaccatctttcattaaaataagtaggacaaagatgccatcatttacaccagtactggagctaaaaggcgtccctcttggaaagatagataaatagactctgctgtttggaataccctgagttatgaataaaatggtcttcagaagctgctcagaatgccttcctgaactattccattttattcttcgtgctatcaactaagcataatgcttcctttgactatgagttgtgagtcattttccattcatgctctaaatctttggaactaataatgattttctatacatcagtaagtacacattgatttgcttctcttccccagatggggaggttgtattgagttggtccatgtaacaggagtcccatgtccctgggacagagacagaaatgcctctcggtctcctgaggctgtagttgttcggattaaaggaggaaagaaggaagtatcaggctgaatcctggctaaggatggaatcctgggaagcatgactgagtgttctttacatctgggaaggcctggagttgttctttcaactaggaagagccaggtgaaagagataagagggatgatcactaaaggaatgttgtttgctcagatggaatctaatccaaggccaattatttgagcaaaacagttccaaattcactcagaaagcttcctgttataacacgtttacattcatctcaggtatgctcagggttcataagttcattgcttatccatattaaaatattgcagggagtgtgagtgaccaccagaaaagttaactaaaggaatatatcagctactctgatggacaatttgaaaacaagaagaaaaatatgcactattaatcaatgttttcagaagtatctaatttagtctggcagcagaacaagggaattcaaaagaaaaatggaattttgttggagggggtcaaagtagaaatgtttcttaagtgttacagtgtgaaaacagagaaatgttaaacttgatgctgtcatacaaataactttgacctcaaaaagccagaaactttgaagaaatcttgatgagtcctacagattctatcatcacctacatatagatctcgatgccaaatctcaaggcagggtacccagcagagagcttctgggacatgtgtccactggggctgcagcaaagtttgtgttacataacactgctggggagattaagcacacagcgaggagggtagcagaactgtagtcactgctgtgaatactctccattaatcaatcgatcaacccacaggtagatcccgagcacctcacctgtgtacaggaaccagacttgcacaagttcgccaaagtgtttcacagaaaaacctaaaaccagctttggcttatgagtttggacagcaaagggcgagaaaaagaaaattgttgggaagaggcagagttaccaatagaaataattaccccagcctctaacagaaaaataacccttatatgcaacttgtgtaggaagtatttaggattcaatattgtaaatagaaatcaccatgtaaattcaaatgcaaagaaaaatattaatttattttattatacaatcgggtcattctacatgtgcaagacacaacgcagttttatactctgtataatttttttttttgagatggagtctcgctgtgtcacccaggctggagtgcagtggtgcaatcttggctcactgcaagctccgcctcccaggttcacgccattctcctgcctcagcctcctgagtagctgggaccacaggcgcctgccaccacgcctggctaattttttgtattttagtagagatggggtttcaccgtattaaccaggatggtctcgatctcctgacctcgtgatctgcccggctcggcctcccaaagtgacaaatatttttaaagacctagaatttggcctgactttctgtataatgtgatattttctagctctgtctttaaatggaattaaacttcttagggatgtttgatttagctctgagcagatttgttataactctgaggattttttctagctgatttttcttaagttctcatgttgagggttcctgtgaactcaaaggcccaaactctgttcaaatacacaccaagggaaatcttgccactgatgacacagtaagtaaaaggtgccaagggagagattctggctaagactatttcttctgtgagagaggacagagtctgtgtcagttatgatggcaactgttggataaaaagcaacacttttacaacagaaatctttttttaaacaatcaaatgtcatggctgcctgcactttctgtatgtgttgtgagcagtcatctaattccaaaacagccctaagcgtatgtcaaatcagtctacaagtttcctacctgtcttcattaggtttttctgatttgtctttgaatttgctggaaactcaatatgggaaagaaattgtgtaggacatcttttaattttttattccttggctcacaccctctgtcactgcagccaccacttttactcaggtgaggcttgacagtcccttgtctcagctgcacagagcatctcttttttccaaccttggggttcctctgccactatctgtgtgtctcctgtaaacttgctatgatggttaatactgcgtgtcaacttgattggactgaaggatacaaagtattgatcctaggtgtgtctgtgagggtgttgccaaaggagattaacatttgagtcagtgggctcggaaaggcagacccaaccttaacccgtgtggtcacgatctaatcagctgccagtccagctagaatataaacaggcagaaaaatgtgaaaggaaagactggcctagccccccagcctatgtccttctcccatgctggatgcttcctgccctcgaacatcggactccaagttcgtcagtttgggaactcggactggctcttcttgctcttcagcctgcagacggcctattgtgggaccttgtgattgtgtgagttaatacttaataaactcccatatatatatatgtgtgtgtgtgtgtatacacatatatatacatacacatacacatatattatatatatatatgtattgcattggttctgtaccgctagagaaccctgacttgcccagacattctcacacaggtgcaaaatggaagggcaaagacatacttaacatacttggatgggtgaccattgactaatgtaggacagtaactgattgataaattttcctctcttgagaactccttgtctcaggcaggcagttctgtggctttgtctgcatgcttccttagagtttacaggcagagctgtgttcaacatttgtagccttggagtggttttccttccttctctgtctcaaacttcccttctctcacttctattccctgggatttcttcccaaaataaactacctgtacatacacaaggtctcttctcaggttctgcttttaggggaattaagagagcaactaagtattttagtagctatttggttgttttaatatgcctttgtgacaaaccagtaggtcatacaagtatgacctactggtttgtcgatggctcggtacagtggctcactcctgtaatcctagcatatttcaagatggctattcagagggctggaaatacaagaatggctgaaaagcgttcacagacagcaacaaacaggagttgtgggtgtttccaacaaaaaaacaaacttgggttacttgaagccactaaatttgtggtaatctgtttcagcagcaataggagactaatacaccagcctggccccagtccccagatgatacacacggctgttggctagtagaattccagtggtattttatgtttttaacagttttgaaaagcatgttttttatatgaagcatcttttccaccctgtttcctccacatctcaaatgtccttgtccaattaaatgcaagctgtcataataaagaaaaacagtttgaaatctttaagattcccagtcaaaagagagactcataattatatataagtgaatgcagaatctattctaatggaaagatttggagatttcatacacacatgcacatacatatctatgtatacacatacaaatcaatatatattccagtacatgtagtacatattagagaatacgaacatatatgcatatgcatgctttagtttgtatgtgtatatgtgtatatatatgtatatttgtgtacatctatttgtatatctgtatctatatatcttcaactaagaggaaaaaagccaagccaaagataatcaacttccatatagcgccatgctaccaataactttttttcaaatactatttctagaaggcaatttgtcagtacctattaaatatgaaaatgtgtacctcttctggcctaacaattcactgttcaggaatttaatctaaagaaatactttaaaaaatgtgtaaagatatatgtatatatttaatattaattgcagtatgttgttttctaaaaaataaaatgaaacatatctgtcattatttaaataggttttagtttattcattaaatgcaaagagtgagattaggatgtatgggcaccaaagcatatccatgaaatattgggtgaaaaaaggaagttttagattaaaatatagaagataaaccataaaaatacatgcattttgatgtaaaggttttcttaggagcataattactttaaatatatatatatttaaaacacaaagagatggtgctatcatcaagatcagaagacaaaaaaacttaagtcagtggattttagtttccatttccagagttaaagtcatatacatgctgtactctatttctctgtatgtatgtttttttctctctcttttctaaaggagagaaaatatagatctttttgcattgtggagtttgggaaacggttaagtctctgagtacttctgagcattttaatctgttgatctcaccaaaggtcatcaattaatgctttttatttataaataacttctgttctttgtttttgagctcaaaatttaagaataaaatcaaacttttttgaggaggttgggattcaaagtgttaaggacttttactaagtaaatgattatttgtttctttttccattttaagtgagtttccatttataggtgaattacttccttatgcaagccagcttttaaagcaactatttaaacgaaaatagataaataaaatttttgaattttttttccagaaagaaaagaggaaacatgaatggagttatactgtgtgccagcctttgtcctagtgacttaaaaatggtataacatttaatgttcatgaatgcctattgagctggaatcatttcttagatctttccgaggagacacagggtccatgaagcacagggtcactttgccacacattcatttttttaattttaattaattaattaattaattaattaattaattaattttgaggcagagtttcactctgttgcccaggctggagtgcagcggtgtgatctcggctcactgaaacctctacctcccaggttcaagcgattctcctgccccagcctcctgagcagctgggactacaggcacctggcaccacactcaggtaaacattcagacatagaactcattactcttttctgtaacatggaacataaaatattctatggttttatgtaggctattagtggaattatttttcttaagcctatgttggctaaacccgatcacttatcttgggcaagtcctgttggtaatgtactaacacagaaagtgcagctatttagaacatctaaaatgataacttatgaaactgtattgctctaaaaaagaagaggataatttaaaatgtataccttgaacatttttctcttgaagactattattagacatttaatcttagatgctaggagattagagctttctatatctttttgccaaatctatatctgtcaaaatctgactttaggcatataccattaacataaattgatatttttggacaaagcttacattataacagatctttctaatactaagtaagcctccagatattttgctgtttagtttggatcttacatttgttctgtagttggataaatacatacctgaaatttagcaaggagtatgtaaacacttgataatattattagtgtgatatgaataatagcattgctccttctgtaagaactaaatgcccacatttatcagagttactacctaatattagagctagaatcacctaaagagattaaacaacaggagaaaaaaaccctgctctcaaggatttcacagtttggtgggagaaaaccttttccattaaaacagcaccctacttcagtgcctagtatatgctaggtgttattggggttaccttcaaatttgctcatttggtcttcataataacctgcctttggagggggattttcctcccccaagaatgtgcttgctttttggtcctttggaaactcctattcatccttcagaatttgttgagatagcttctttatgaattcttttggccaggtgctgtgactcgctcctgtaatctcagctactggggaggctgagatgggacgatcatttgagcccaggcatttgagaccagcctgagccacatagcaagaccctgcctctaaaaaagtaaaataaaataaatgaattctaccttggcctgcctcctctcagctgtcccctataggattaatcttcccatctcttaatgatttctgcatatatttctataacagaaatcaccttgagctgaaatttcatggttatctctctgtgacacaacagtgagatcctttgaggaagaggattttgtcctattttgctcattcaagtcaaccccaacactgttctactggatgatccattcaaatcttgaaaggcgaacgtctccccctcacggacagtaccggaattcaacaagtgaaagttcaattttattctaggaagcttctctagtgaggcagatttgccagtgtctgtatctttgtcaatcttcacggcaatcttctgaagtcatccctttgctttcttgcatcctccactagacagttgggtgagagatgactcttatttgattctctctctatctaaatagtaactgaagcctgtggacagtctataagtgtttaccaaaataaatcctccttaccctactccattttttaaaaatcaactttatttaggcataatctacatacaataaaatccacacatttcacacgcaccggttgatgactcaataaatatatacttctgtacattcattactcaaatcaaaatataaaatacttccatttccccaggaaattccctcatgcccttttgtagttaatctcccccattcagctgccactccagagatgagaatctccttttgttgcagtagtatagttttgcctattctacatattcatgaaaaattgaatctcatgatatgtactcttttgtgtctggcttcttttattcaattcgatgtctgtgaggttcatctatgttttgcaaaaggaagtaatgtattcttttttactgctgaatagtattttactgtctgaatatatgacagtttctttaaccattcacccattaatgacatttgaattgtacccagcttggctactatgaacaaagatgccatgagtattcatgtacaagttgttgttttttgtttgtgtttgtgtttgtttttgttttgttttgttttgtttttttagatggagtttctctctttgttgcccaagctggagtgcagtggcatgatctcggatcttggctcactacaacctctgcctcccgggttcaagtgattctcctgtatcagcttcccaagtagctgggattacaggtgcctaccaccacgcctggctaatttttgtatttttagtagagatggggtttcaccatgtcagccagggtggtctctaactcctaacctcaggtgatccacctgccttggcctcccaaagtgctgggattacaggcgtgagccactgcacctgacctcatgtacaagttttttaaaaatggatatttgtaacttttctcttgggcaaatacctgccagttagtaacttaatatggtaactatatgtttaattttatatgaatatgaaactgcaacgtgttttaaacatatctgcagtattttacactcccatcagcaatgtagaagtttcagaagctcactgtcagtcctttttcccactgctgataaagacatacctgagactgggaagaaaaagaggtttaattggacttacagttacacatggctggggaggcctcagagtcatggcgggaggtgaaaggtgcttcttacatgatggtggcaagagaaaatgaggaagatgcaaaagcagaaacccctgataaacccatcagatctcatgagacttattcactaccatgaggacagcatgggggaagccgcccacatgattcaaattatctcccacctggtccttcccacaacacatgggaattatgggagtataattcaaaatgagatttgggtggggacacagagccaaaccatatcattccacccctggcccctccaaatctcttattgtcacattttgaaaccaattataccttcccaacagtccctcaaagtctaaactcaattcagcagtaacccaaaagtccacagtccaaagcctcgtctgggacaaggcaagtcccttccacctatgagcctgtaacatcaaaagcaagctagttacttcctagatacaatgggggtacaggtaatgggtaaatacagccatcctaaatggtagaaattggccaaaacaaagggattacaggctccatgcaagtccaaaatccagcagggcagtcaaattctaaagctccaaaatgatatcctttgattccatgtctcacatccaagtcacgctgatgcaagaggtagattcccatagtcttgggaatctccacccctgaagctttgcagagtataacgcccctcctggctgctttcatgtgctggcattgagtgtctgcagcttttccaggcacatggcacaagctgttggtggatctacgattctggggtctggaggacagtggccctcttctcacagctccactagacagtaccccagtagggaatctgtgtaggggctctgatcccacatttccctccaacattgccctagcagagttctccatgagggccctactcttgcagcaaacttttgcctgggcatccaggtgtttccatacatcttctgaaatctaggtggagtttcccaaacctcaattcttgacttctgtgcactcgcaggcacagtaccacgtagaagctgccaaggcttggggcttgcaccctctgaaaccatgggccaagctgtaccttggtctcttttagcaatggctggagtagctgggacacatggcaccaagtccctaggctgcacaccacatgaggaccctgggcctggtccatgaaaccattttttcctcctaggcttccaggtctgtgatgggaggggctgccatgaagacctatgacatgccctggagacattttctccattgtcttggtgattaacatccttgttacttatgtaaatttctgcagccagcttgaatttctcctcaaaaaattggtctttttcttttcttttctgctccattgtcaggctgcaaattttccaaacttttgtgctctgttttaaaatggaatgcttttatcagcacccaagtcacctcttgaatgctttgctgcttagaaatttcttctgccagataccctaaatcatctctctcaagttcaaagttccacaaatctctagggcaggggcaaaatactaagagtctctttgtaaaacataacaagagttacctttcctccaattcccaacaagttcctcatctccatctgagaccacctcagcctggaccttatcattaatatcactatcagcatttctgttaaagccattcaataaatctctaggaggttccaagctttcccacattttcctgttttcttatgagccctccaaactgttccaaactctgcctgttacccagttccaaagttgcttccacattttcagatatcttttcagcaacactccactctactgttaccaatttactgtattaatccattttcacactgctgataaagatatacataagactgggaagaaaaaggggtttaattgaacttacaattccacatggctggggaggcctcagagtcatggcggaaggtgaaaggcacttcttacgtggtggcggcaaaagaaaatgaggaagatgcaaaagcagaaacccctgataaacccatcagatctcgtatgacttattcactaccatgagaacagtatggggaaatggcccccatgattcaactatctcccactgggtccctcccacaacccatgagaattatgggagtacaattcaagatgagatttgggtggggacatagggccaaaccatatcattcactaaaagtttggtattattaggctttctaattttaaccattctagtgggagtatagtggtatctcattgtggtttttagttttccctaatatctaatgatgttgagcatctttttatgtattactagccatttatgtatattcttttgtctattttaaaattgggttgtcttattattgagttgtaatagttctttatttattcatcgtatatatgtgtctttaatcatatatatgtgttccaatattttctcttttatttcatacatgtgttttatcatatacatgtattccaatgttttctcctagtcaacagctggctttttattttttgacagtgtctttgaagaccagaaagtttttattttaaaaaagttcaatttttcctttatgattagtattgtttgtgtcttatctaaaaaaaaactctgcatatatcaagattaaaagattttttttgttttcctctagaagtgttatagttttagctttaataatcaggtttattattacattttaaattaattgttttgcatggtgttagataagcattatgttttatttttcttcttcttctttttttttttttttgagatggagtctcactttgtcacccaggctggagtgcagtggcgcaatctcagctcattgcaagctccgcctcccaggttcatgccattctcctgcctcccaggtttacaccattctcctgcctcagcctcccaccattctcctgcctcagcctcccaagcagttgggactacaggcacctgccaccatgcccggctacttttttttttcttgtatttttggcagagatggggtttcaccatgctagcaagaatgggctcgatctcttgaccttgtgatccacctgcctcagcctccattacaggcatgagccactgcgcctgaccttattattcttcttatacaaatatccagttgcttcaatatcatttattgaaagaagtatcctttccttatgagattgcattgctgcccatgcaaattatcaattggccattatgtgtgagtctacttcaggactttctattccattgatctatgtgcttatatttaactttaccacactgtgttgattaatgtacttttttactacacattgaaactgccaactttgttttctttttcaaaattatttctctgttctggtccttcacatttccaagtaaatttttgaattattatgtcaatttttacaaaagtcttctggaaatttgaccagaattaagttaaatttgtagatcaacctagggagaataaacatcttaacaatatcaggtcttctaatccatgaacaaggtagacctctctcaatttacttatatcttctttagtttctatccatagtgttttatggttttcagttttctctgaatctatcatgatatatcattttcccccatttttctcttaatatgatgaatacattgaatttcttttgctagcctcatcttgctttcttggtataaagcttactaagttatgatgtattatgatttttacatattatgggatttaatttgctaaaattttgttaaggatttttgcttcaagactcataagggactttaatctgtaatttcatctcttgtgctatttatgtctggttttgatattagaaccttgtaaaatgagttctgaaacgttctgtccttgtcttgtttctgaaaatgtttgtataggattgctaccaactcttccataatgtcttgagttatgattgagttagcaaatgaaaaaatctgtgcctttaagtttcatcattatgataggacttactacaaattcagtttctgaataggctttctattttctcttgtaacttttgattatttagaatttttttaatttttttaatttattattattatactttaagttttagggtacatgtacacaatgtacaggttagttacgtatgtatacatgtgccatgctggtatgctgcacccaccaactcgtcatctagcgttaggtatatctcccaatgctattcctccccctccccccatcccacaacagtccccagagtgtgatgttccccttcctgtgtccatgtgttctcattgttcaattcccatctatgagtgagaacatgcagtgtttggttttttgttcttgggatagtttactgagaatgatgatttccaatttcatccatgtccctacaaaggacacgaactcatcattttttatggctgcgtagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaagtggtgtgagacggtatctcattgtggttttgatttgcatttctctgatggccagtgatgctgagcattttttcatgtgttttttggctgcataaatgtcttcttttgagaagtgtctgttcatgtccgtcgcccactttttgatggggttgtttttttcttgtaaatttgtttgagttcattgtagattctggatatcagccctttgtcagatgagtaggttgcaaaaattttctcccattttgtaggttgcctgttcactctgatggcagtttcttttgctgtgcagaagctctttagtttaattagatcccatttgtcagttttggctcttgttgccattgcttttggtgttttagacatgaagtccttacccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcgtgtttgtcaaagatcagatagttgtagatatgcagcgttatttctgagggctctgttctgttccattgatctatatctctgttttggtaccagtaccatgctgttttggtaccagtaccatgctgttttggttactgtagccttgtagtatagtttgaagtcaggtaatgtgatggctccagctttgttcttttggcttagggttgacttggcgatgcgggctcttttttggtcccatatgaactttaaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcctttatttccttgagcagtggtttgtagttctccttgaagaggtccttcacatcccttgtaagttggattcctaggtattttattctctttgaaacaattgtgaatgggagttcactcattatttggctctctgtttgtctgttattggtgtataagaatgcttgtgatttttgtacattgattttgtatcctgagactttgctgaagttgcttatcagcttaaggagattttggctgagacagtggggttttctagatatacaatcatgtcatctgcaaagagggacaatttgacttccccttttcctaattgaatgccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtctgtcatagatagctcttattattttgaaatacgtcccatcaatacctaatgtattgagagtttttagcatgaagcattgttgaattttgtcaaaggccttttctgcatctattgagataatcatgtggtttttgtctttggttcggtttatatgctggattacattcattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagattctgttattggtctattcagagattcaacttcttcctggtttagtcttgggagagtgtatgtgtcgaggaatttgtgcatttcttctagattttctagtttatttgcgtagaggtgtttatagtattctccgatggtagtttgtatttctgtgggatcggtggtgatatcccctttatcattttttgttgcatctatttgattcttctctctttttttctttattagtcttgctagtggtctatcaattttgttgatcctttcaaaaaaccagctcctggattcattaattttttgaaggatttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttctttatgtacccagtagtcattcaggagcaggttgttcagtttccatgtagttgagtggttttgagtgagattcttaatcctaagttctagtttgattgcactgtggtctgagagataatttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcacagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgagtctgggtgctcctgtattgggtgcatatatatttaggatagttagctcttcttgttgaattgatccctttaccattatgtaatggccttttttgtctcttttgatctttgttggtttcaagtctgttttatcagagactaggattgcaacccctgtctttttttgtattccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctctttagttgatgcagtttcttcctagtctcgatggtctttacgttttggcatgattttgcagcggctggtaccggttgttcctttccatgtttagcacttccttcaggagctcttgtagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccgagagatccactgttagtctgatgggcttcgctttgtgggtaacccgacctttctctctggctgcccttaacattttttccttcatttcaactttggtaaatctgacaattatgtgtcttggagttgctcttcttgaggagtatctttgtggcgttctctgtatttcctgaatctgaatgttggcctgccttgctagattggggaagttctcctggataatatcctgcagagtgttttccagcttggttccattctgcccgtcactttcaggtacaccaatcagatgtagatttggtcttttcacatagtcccatatttcttggaggctttgctcatttctttttattcttttttctctaaacttcccttcttgcttcacttcattcatttcatcttccatcgctgataccgtttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggcttgaatgtcctcccgtagcttggagtaatttgattgtctgaagccttctctcagcacgtcaaagtcattctccgcccagctttgttccattgctggtgaggaactgctttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttagttttccttctaacagacaggactctcagctgcaggtctgttggagtaccctgccgtgtgaggtgtcagtgtgcccctgctggggggtgcctcccagttaggctgcttgggggtcaggggtcagggacccacttgaggaggcagtctgcccattctcagatctccagctgcgtgctgggagaaccactgctctattcaaagctgtcagacagggacatttaagtctgcagagtttactgctgtctttttgtttgtctgtgccctgtccccagaggtggagcctacagaggcaggcaggcctccttgagctgtggtgggctccacccagttcgagcttcccagctgctttgtttacctaagcaagcctgggcaatggcgggcgctcctcccccagcctcgctgccaccttgctgtttgatctcagactgctgtggtagcaatcagtgagactccgtgggcgtaggaccctcccagccaggtgcgggatataatctcgtggtgtgccgttttttaagccggtcggaaaagcgcagtattcgggtgggagtgacccgattttccaggtgcgtccatcacccctttctttgactcggaaagggaactccctgaccccttgcgcttcccaagtgaggcaatgccttgccctgcttcagctcgcacacggtgcgcgcgcccactgacctgcgcccactgtctggcactccctagtgagatgaacccggtacctcagatggaaatgcagaaatcacccgtcttctgcgtcactcactctgggagctgtagaccggagctgttcctattcggccatgttggctcctcccgattatttataaatttttaaaaatttatacattttatctaagttgtcaaatttatttacataaagttcacaatgtttccttattattttaagattggtgagattagtagtgtccttttatttctgatattggtatgtgatttttatctctcattttcttggttactcttattgtgtcatttttttcaaaacactaactatggctttattttatgtattgtttatctgtcttctattttactgatttctgcttttatctttattatttgtttcttctacttatgttcagtttaccatttactttccatttacttgtttgcttcttaaagttaaatattaaatcattaattttgacctttcttccttaatatagacaatgatgtctgaaaaataccttctaagccatgctttataagcatcccagaaacttaaacacattgtgtttttattattattcagctcaaaatacttctttatttctcttgcaacttctttaatccagtgtgtgttatacaaagtccaaatatttgaggctttctgccatattttactgatgtctaattcaatttctttgcaggcagtggacataatctgaaatcattcaataaaatgtactgagatttatttcatgggccaatgtatgatttattatttcaggtgtaattttgagtttttggatgtaaggcctgtaatgtgcattagatacagttgactgagaagatagtttagatattatattttcttactaatttttgtctacttatcttgagaggtttttaaaatctctctacataaatgtggatttgactatttatatttttatttctgtccattttacctcatgaatttgactctttgttattagttgcatatatatttagaattgttatgccttattggtgaatggctgcttttatcattgtgtatacttaaagtctgcttcacctgatattaatatagctcctccaccttccttatgtttactctttgtatagtgtagctttcctacctgtttatttctaacctacctctgcctttattttaaaaatacaccttttacatggcacattagggttttgtttctttgattttaaattttttatttttgatttttgttggtacatagtaggtgtgtatatttatggggtacatgagatgttttgatacaggcatgcaatgtgaaataagtacatcgtggacaatgaggtatccatccacaaatcctcaagcatttatcctttgtgttacaaacaatccaattacactcttttagtcatttttaaatgtatgattaaattatcattgactatagtcaccctattctgccatcaaacagtatgtcttactcattctttctatttttttgtacccattaaccatccccgtctcaccttcattccccaccacccttctcagcctctggtaaccatccttctactctctatttccattagttcaattgttttgatttttagatcccacaaataagtgagaacatgtgatgtttatctttctgtacctggcttatttcacttaaccatctccagttccatccatgttgttgcaaatgacaggatttcattcttctttatggctgaatcagactccactgtgtatatgtaccacattttctttatccattcatctgttgatggacatttacgttgcttccatatcttagctattgtgaatagtgctacaatctacattttctttatccattatctgttgatggacccttagattacttccaaatcttagctattgtaaacagtgctgcaacaaacatgggagtgcagatatctcttcgatatactgatttccattcttttgggtatatatacccagcagtgggattgctggatcatatagtagctccatttttatctttttgaggaatctccaaactgttttccatagtggttgtactaatttacattcccatcaagagagtataaggtttcccttttctccacattctcaccagcatttgttattgcctgtattttgggtataagccattttaactgagatgagatgatgtttcattgtagtttttgatttgcatttctctgatgatcaatgatgttgagcacttttcatatgcctgtttgccacttgtatgtcttcttttgagaaatgtctactcaaatcttttgcccatttatggattcaattattagactttttcctatagagttgtttgagctccttatatatctggttattaattccttgtcagatggatagtttgcaaatattttctccaatcctctgggttgtctcttcactttgttggttatttcctttgctgttcagaagctttttaactccttgtgaaccaatttgtttatttgtgtttttgttgcctatggttgggagatactgctcaagaaatttttggccagaccaatgtcctggagatttcccccaatgttttcttgtagtagtttcatagtctgaggtcttagatttaagtccttaatctagtttgatttgattttttacatatggcaagagacaggagtctgctttctttcttctgcatgtgaatatctagttttcccagcatctattgaagagactttattttaccccagcatatatttttggcaccttttttttttggtccagtatgaaaatctctgtcagttgatgggtattagtttatttacttttaacataattgctgatatggctgaattcctatcttgctcctaacataccttcttttcggtttatcaacattttttaatactcagtttttacttgctctagtagtttcctaactatacctcttttattgtattttaattggtttctctatggctaactgtatgcatccttaacttaccagaattaatttagaattaatattgtaccttttaaaacttcaacatataacacaatacgtttgactttaacctttctactttccacttcccaatatatactttccacttcacaaatataatgaccttgcaacggtataaatccaatacttgtctcctaattctttgtgcaaatgctatcgtagcttttatttctatatacatataaatttctgcttctaatattatttttgctttaaacataaattacattttaagtactttttgaaaagaaaataaacctagtcttttgtatttactcatttatttactatttctggtgtatttcattccttcctgccgatccaaattttcttggggcataacttccctttggcctcatggttttccctttagaatttctggtcatggcaattgctggtggaaaatgtactcgggttttattctgaaaatgtctttattttacccttatttctgaagaaaattctcgctggatattgaattctctattgccagtattttctttcaagctttcatatcttacatcattgttttttggcctgcattttttaaaaatgtgtaataaatttatctttttttccctacaggtaatgtggggttttttttttcctctgtctgctttcaagattttttttttcatttttgttttttagaagtttgactattatgggcataactatagatctctttacatttattcttaagtaagttgtaatttcatcaaatttggaatattttcagccactatttcttcaaatatatatttttctgtctcattcacactctccttttctcagggactcaaataaatgtattttacaccattgatattgttcaacagacccctgaaatactgttcatttttctttaatctttttaacctcattacttacattgaataaattctattgattgattttcaatgttcctgactcttttttttttttttgctgccatcttcaatcttctggccccatctaataaaatttatttgtatttcaattactagattttttatttatagagtctccatatgatttttttatagtttccatttttctgtggaaactccctatgtgttcactcattaagatcagatttttctttaatttttgaccatatttataaaagcagcattaaagtctttttctattaagtccatttttttggccatcttgggtttgttatctatttttttcttttttttttttcttgactgtagagcactgcttctttgtatgactaaggagttatgtactgaacactgaatattggcaatcatatatcttaaagattctggattttgttagttttctccaaagaatgtggattcttattttaacaaggaattcatttgtttttaactcatgtagggtttggtataattgtaagcctcggatggtcctgcctggttgcaggtataagtccagcccttattcataaaccagcagaggacctccacatacaccttgaggaccactctctgcaatctccttatttttccgatgccatatttcacagactctagctatttcagcagccctaccctctgaattctgcctccttagttcagttagactgttaagctatgctgggacccctgttctctgtgcagcaattgggaaattgtttataacagagattcagggaagtgatggaactaatcttgtgagttgtctttctctaggggtcacagtcctctcttgcccgagttccattgcccaaaaacagttgactcacatatcttgtctaattttataggtgtttattgtggtagggctaatttggtgccagttttttcattcatgtctagaagtgaagttccactacttctgtctttttttccccctcatggcacttattaccctctcacatattagaaaatttacttatatgtcagacattaatagattattatctgcctcttctcaccaccttaccagaatataagcttcatatgaataaaggtatttgtctgttttgttcactaatgtatctcaggcacctagaacagtgcctggcacgtagttggtgcttaatcagtatattatctcagtcattttacaaataggagatggctcaaagggtgcatctatatgtattttttaactttcacattaataagtggtaaaacttgcttttgcatttgttctcaaacttctgactcaaaaacctatgttcttctcacagtagccttcttctttttctagtttctaaagtaagacagagaagaggaaatattaaggaataaaaaaactcggaggcaaaatgcacaactatgtctccatgaacttcctaagaagaggctaattataggtttatttactaactaaatacaatttattctacattctaggtggaaagctctgtacacaatgattaagacttattcctgggtaaggatattagtgaatctgattttggaattgtagttttataatcttatttatttgtgttttactttttaaaaactaaatatgatttttgaatgagaaattggagaaattgaagtctagtcatggcctagtctagtcatctatctattagctgtgaaactttgggtaaatagtaacctttatagacctgttattttcccccaaaattgttctagtaatacatgtttattccactacttctttttaatgtagatgaaacaagaaaaggaattccaaatgctttgaaaattataaactgcaatgtattaaatattatctgagctgtttaaaatttaaagttggtaagcctttataagtagtatgttaaagattacaagtaaaatgatatgtaaagagcagcagcagtattgaaggacatgtgtttattttgtgctaaattgaactttgcagcaggccttaataaacctaaaccagaaaagaaaaatttcttttacttatttgcttgaaaagaatgttataagacaaatttacttcagatttcttcaaaactttccattaaacttgttgtgggtataatgagggaaacttttactaatataaaaatataagacatagagtaaaaatgaaaagctatttcagggtacaatttcagaaaaggatttaagagtttggatcatgtttccacttcagagctccttcaagggattgaggggaaatggtgtagttttgttttcagttacaaatcggcatgatatacattatgtaaaaattatgcgagattaaacaccttttagttgcccaaggagaaatgcttctttctttcacatataaattcaaccttggccaggcgtggtggctcaagcctgtagtcccagcactttgggaagtcgaggcaggtggatcacttgaggtcaggagttcgagaccagcctggccaacatagcgaaaccccgtctctagtaaaaattcaaaaaattacccgggggtggtggcatgtgcctgtagttccagctacttgggaggctgaagcaggataatcacttgaaccaggaggcagaggttacagtgagccaagattgtaccactacactccagcccgggcaacagagcaaaacttcatctcaataaaaataaaaatgaaaataaaaataaattcatccttaataattttctttgttgatatgaatacttgttctgtttgatttagaaagtcttgcataattcagttgtatttctcttctcttcccttgggaatgcaatgaggaactggttatatatatactttgtaaagaaaatgtggtatcttagactaaaactactttagcaaatagtagttggtaagttaacaccaactactcccatccagaaagaaccaaccacataattctgggtttagtatagcatttatctcggcctctgagatcacattttaaagtgttaaaattgaatcttctctttgggatgttgcggtgagaattgttttttaagggaaaaaaatggagaaaaaatgggcaaaggaaattaacaagtaaaatctaaatagcttgaccaaaataaaattcgtttgaaaagaataaaaattaatgctttcaacctagtacaataactgagaactagataaatctatggactaagaggtccttgtagatactgcatgtgctaggatgaataaaagagattggaattagcaaatagattatgtgtcagtaaatatatgcttttaaattacttgaaggcacacaaaacagtttgtttaaaataacttgaagatcttagacattccctctcaaatgttatttacccactgcctcgctttgtttcagaaagctgtattccattcttttgctagaatgtaaaagtacacccatcatctttgtccctggtcctttaaggttaagtagaacactgacaaataatattcctctaatggagtctaaattaggagtaacaccttctcttataatgataaaatgagcactgagacctcaagattttaaaaagccatcataaggggtagtaaaaacggttacaatcactatactgcattgcaaattgtggtgactttggtttggaatatagtagtatgtcagcaacagatactgcttactctaaatcaacattcctttttctaacttactaaagaatctcaattttctacaggtatccacctatgcctcatgttacttggggagaggtgaccctatccttgcctcaggggcaaatattagttgggacaaaccagttatgataggtaatctcatcctcatctgccaaccctgccccactgacccagagttgggtcccatgcccagcatgggaatatgagagcaggttttttttgctttttggaaaggtttccttctttttaagacaaaggtgctagaagtaacggcatctttgtgcttccatgtggatgtaacgtgagctgcgatagctgtcttgcaaccctggggagagctatctgtatcagtttattagggctgccataacaacgtaccatggactgtgtggcttaaataacagaaatttatttgctcacagttctgaaggctggaagtctaagatcaaagtgttggcagggttgctttctcctgagggctcttgccttgactcttctcattgtgttctcacatggtcttttcctggtgcacgtgtgcacctgttgtctcttcttgggtgtccaaatttcctctttttataaggataccagtaagattgaagtaaaacccattctaatgacctcctttcaacttcatcatctctttaaaggctctatctctgaatagttatagtctgaggtactggaggatagggcttcaacatatgaattttggggagaggcaattcagcttataacaccacccatgggacaaatgagctcgctgacaatggtagaaaatatcaatggaaaaaatctgggtcctggatatgagataatatatatccttatgctgtgtaagcaagttgaatatgcattttctcttacttgaaattgaagacacataccttatatctaagaaccatggaacaaacaaaaaaccatcaatgtcactcctcttcctagactgcagagtttcaccagttagtctgtaatattgaaagagcatctggaagttcttccagttggagaaatagctgcatgtgttgaagaaccttctcaagtggcaagaaatcttcctcttgtagcactccccaggaaagatttggtattctttggacccagagaaaatgcttcaagtttttgaagctgcaaaaagactcaagatagttacatacagatttaaagtgtgccaatggaaagaatgttgtattcgggaaatacttagtttcttttatgtgcattttccccatgacaatgcatgaaatgtgaatattaatatttagacagccccttaatggttagatagctagcaaccaggctctgaatactacaagtaaaaaaagttctacagaaagctatttcttataaatattttattaaatggctaatgaaaaataaatagtctgcatttatctagttattgcacaaaacattttcatgcgcattattttagtgaatcagtacaccagggtgggatttttgtggacttattttgcataccaagaacttacattaaattgtccattcaaatgaataataagagtaggagccaggaaccacaggcagattttctgtctctaataggtagaaatcccaatttgcaaaacaaatacataaacaacaaaacaaaatataaagcaaccataagcatatttttaaagattcttttatcaaatgacaggcatttttgccaactgggaaaaaataatatggaaaaatgttatttggctttaaaagaaatgaaaggtataaaagtagaatcatgaaatttctaaagtaaaaaatgtctggattcgggcaagatggcccactagatgcagccaggtagaactgctgccactgagggactgggatgactggcacactcctaaaagatcttcagagggaaggcactgacagtgaatgcagaaaaaaacacagaaactgggctgaaggggaagaagctgggaaccatgtgtggggcttctgcacaccaggactcattcttggcccccaattactccaggggaatgggcgagttgaactggcagcaaacaactcgctctagccatgagcctctggaatcccagcaagaggaaacccctcaaccactagggacacttgagttggcagggagagctgcttagagaagtggtaggggcagcaggccagctgatgcagagcctacagggcttgctgtaggagcatttgtagtagagtagggccaggggtgcccatccctccaggatcaacttgctcccataggagactttagccctaggggaactgttggaacaaaattctgcagtgttgtcttgcccttcagatggggtggtgtgacctgagcaccccttgttccactggtttcttctgggttcccagcctggctgcacctgtttgcattgcagcctctggtgccctgggggcctgcatcatagcttctgcactggtagatcattcctgaacagtggacagcttcagtagggcagtcctcactgccatacaccagtctgcccactcccccttcccactgcagcttccccagggtccatggccacccccatattgctttgtcaccatgtgtggtggggggacactttgccttccctgccctaccagggcacatggatgtgtggaccctgccagcaggagtgcactctgccttccctcacccaccatactgccattgaagttggagccttggcaagcacagagcccactagccccacccctgcaccaacactgggagtgaaactaggcacacagaacaatagaccctcccctgccctgagcggccacagagggtacacaaagacctgtgcccgccagtgcccctcctctgtgctaacaccaccaacaatgcaaccatgcatacagtcaccaacaggatgccccctgcccacaccaatcataccacctttgccactgctgtgaacacctgcatgaaggcaggcaccccaacatccactagcatcctgcgacagccgacgggtgtgcaccccaccacactgccactgctgctggcacatatgaatgagaatggatcgcactgccatcaccctatgaaatgctttgtctggcagcatgtatcagaatgcaatcaacagtggccaacaagcacttaggcacccctgccccatgcagtggattcctaacctcaaggaaccagagaacaaagttagggcctgttataaatcctccagaggtagagcacacagtctaggagttgggagatgactgttggtcccctaaaatcttccaaaaatgaatccagtagactggacccaccttataccacaagcaaaccctcaatgccatcaaataggataaaagaaaaaaatctaaaggacagcaacttcaaagattgaaggaacaccagtccagaaacatgagaaagaacccgcacaagaagcctaataacaaagagccagagtgccttctttcctccaaacaaccacactacctctccagcaagggttctgaactgtgctgagatggccaagatgacagaaatagaattaagaatatggataggaacaaagatcattaagatgcaggagtacattgaaaccaaatccaaggaagctaaaatcacaatgaaacaatacagaagctgacaaacaaaatagccaatattaaaaagaacttaaacaacctgatagagtggaaaaatgcactgcaagaatttcataatgcaatcacaagtattaatagcagaatagaccaagctgacgaagaatctcagagcttgaagactggctttctaaaaataagacaatcaggcaagaatacagaaaaaagaataaagacacataaacaaaacctccaagaaatatggcattatgtagaggccaaatctatgactcactggtgtccctgaaagagatggggagaagagaatcaaattggaaaacacatttcaagatttcagtcatgagaacttccccaatctagctaaagaggccaacattcaaattcaggaaatgcggagaaccccagtaagttacttcacaagaaaatcttcataattatcagattctccaaggtcaaaatgaaagaaaaaatgttaaaggcagggtgagagaaaggtcaggtcaggtcacctacaaagggaagtccatcagaccaatagtggattttttagcagagacccaacaagacagaagagattggaggccaatattcaacattaaaaaaaaaaaagaaattccaaccaagaatttcctatccagccaaactaagcttcataagcaaaggagaaataagatcccttttcagacaagcaaatactgagggaattcgttaataccagacttgccttacaagagcttccaaaggaagcattaaatttgaaagactaatcagccactacaaaaacacacttaagtacacagaccaatgacactgtaaagcaaccatacaaacaagtctgcataataaccagcaaatatcacgatgacaggatcaaatccacacatatccataccaactgtgaatgtaaataggctaaatgccccaattaaaaggcacagagtggcaagctggataaaaacgcaagactcaatggtatgctgtctttaagagacccatctcacatgcagtgacacccatagactcaaaataaagggatggaaaaagtctaccaagtaaatgataaacagtaaaaagcagaggttggaattctaatttcggacaaaacagactttaaacaaagattaaaaaaaagacaaagacattacataatggtaaagggttcaattaaacaagaagacctaactatcctaaatatatattcccctaaccgaggagcacccagattcataaagcaagttcttagatacctacaaagagacttagataaccacacaatattagtggaaggcatcaacaccacattgacagtattcaacagatacatcgagacagaaaattaacaactcagcactggatcaaatgggcctgagagacatccacaaaactctccactcaaaaacaaaagaatatgcattcttcttatcaccacatggcacatactccaaaattaaccacataatgagacataaatcactcctcagcaaatgcaaaagaactgaaatcataacaactactctcttggaccacagtgcaatcaaattagaaatcatgactaagaaatttactcaaaagcatataattacattgaaattgaataacctgctcctgaatgacttctgggtaaataattcaattaaggcagaaatcaaaaagttccttggaactaatgagaacaaatatacaacacatcaaaatctctggacacagttaaggaagtgttaagagggaaatttatagcactaaaagcttacatcaaaaagttagaaagatctcaacttaacaacctaatatcacaatgaaaaaaactagaaaaccaagagcaagccaatcccaaatatagcagaagacaagaaataaccaaaatcagagatggagacatgaaaaaccattcaaaagatcaacaaatccagtaggtggtttttaaaaaatattaataaaatagatcactagctagactaataaaaaagaaacaagagaagatccaaacaaatacaatcagaaacaacaaagggaatattaccactgacccgacagaaatacaaataaccatcagagaatattatgaacacctctatgcacacaaactagaaaatccagaagaaattaataaattcctggatatatatacccttccaagtgtgaaccaagaagaaactgaatccctgaacagacaaataatgagctttgaaatttaatcagtagtaagtagcatatcaatccaaaaatctcaggaccagacagattcacagctgaattctagcagatgtacaaagaaaagctggcaccattcctgctgaaactattccaaaaattgaggaggggggactcctccgtaactcattctatgaggctacgatcatcctgataccaaaaccttgcagagacacaacaaaaagagaaaacttcaggccaatatccctgatgaatattaatgcaaaaatcttcaagaaaatacttacaaactaaatctggctgcgcatcaaaaacaatatcaactaaaatcaagtaggctttatctctgggataaggtttagtcaacttatgtgaatcaataagtgtgattcatcacataaacagaactaaagacaaaaaccatgtgatcatctcaatagatgcagaaaaggcttttgataaaattcaacactccttcatgtttaaagctcttaataataagagccatctatgacaaacccacagccaacatcatactgaatggccaatagctgggagcattccccttgaaaaccagcactagagaaggatgctttctgtcactattcctattcaacatagtattggaagtcctggccagagcaatcaggcaagagaaagaaacaaagggcatccaaataggaagacaagaagtcaaaatattcctgttcacagatgacataattctatatctagaaaaccccatagccttggcccaaaagctccttaagatcataaacaatttcagcgaagtctcacgatacaaaattaacatgtaaaaatcactagtatgcctatacaccaaccaccattatgcagagggccaaatctggaatgcaatcccattcacagttgccatgaaaataaaaaaatacctatgactacagctaaccagggaggtgaaagagctctacaatgagaactagaaaacactgctcaaagaaatcagagatgacacaaacaaatggaaaaacattccatgcttatgtatagaaagaatcaatatcattaaaatggtcatgctacccaaagcaatttatagattcaatgctattcccatcaaactaccaaggacattcttcacagaactaatgaaaactattttaaaagtcatatggaactgaaaaaaagcccaaatagctaaggcaataaaaaaaaaaaaaagctgggggcttcacgttaccagacttcaaactatgctacagggctacagtaaccaaaacagcatagtactggtacaaaaacaggtaaagcaatggaactgaatagagggcccagaaataatgccatatgcctaaaaccatctgacctttgacaaagctgacaaaaacaaacaatggggaaaggactctctattacaatagcaaatcctgtttaaatgcccattaatggtagattggatagagaaaatatggtacatatataccatagaatactatgtggccataaaaaagaatgagatcatgtcctttgcagaaacatggagaaagctggaggccactatccatagcaagctaactcaggagtagaaaaccaacaatgcatattctcacttacaagtaggagctgaataatgaaaacagatggacacatagtggggaacaacaaacacggggcctacaggagggtagagggtagaaggaaggagacgataaggaaaaataactaataagtactaggcttaatacctggattactaaataatctgtatgacaaacccccatgacacaagtttacctttataacaaatctacacatgtactcctgaacttaaaataatttaagtaaaaaaaaataaaaaatttgaactgaaaaattctctggatgtaatacatcagggaatattttaatattttttttgaaaactaataatataagatatcttaataacataaagagaaaaaagacattatagacaggggagctaaaataagaatgattactgaactgaatacaagctagaaggctataaaacgacttatttcatgtaacagaagaaaaatgggccaggtgcagtggctcatgcctgtaatctcagcactttggaagggaggctgaggtgggtggatcacttgaggtcaggatttcaagaccagcctggccaatatggtgaaaccctgtctctactaaaaatacaaaaattagccaggcttgatggtgcatgcctgtagtcctagttacttgagagactgaggcacaagaatcacctgaacttgggaggtggaagttgcaacgagccaagattaagccactgcactccagcctgggagacaaagtgagactccgtcttaaaaaaaaaagaaaagaaaaaaaattggaaaactcacaactgtcaaacaataatcaataagaagcgattagatctgggaccgaagatcttattagaattgtgatcaaagagtaaaactcaatcattagaattttatttggttccccttcacaggtaccatgtaggaggtaccaaagaaccagacatctgtaaactaaaattttatttttctgttctcaactaattgtgcaactgtcttactgtcaaatctctaaaataggtggtcaaactaaatcttagactcttctaagattctttgaaattgtgatgtggagtagaagcaaaaaatatcaaaattaatgcctccttatagagcatccaaaaatgttttctaactgcatatttgatgcaaatgtacccaaagaatttatcgtattatccagacaaattatattcaggcatatatatgtatgtgtgtatatatgtgtgtgtatatatacatatagatatatatgttttaacatttgaaatgtaattcatgacattggaaccatttttgtattgaattagatgtaaaataaattgatactgattccattttacaaaaaagttaccatatagttaaactataataatttccattgatggaaattaatgccactgaattatgtaaaactgtaaaaaatataggcatgttccttttgttttatttcagaacatatttctataccaatgagtaaataataattttatgtttctttgtggtaatcagaaaaaaatacacactactcttttatttatgcggatttaattaccatatttacatattttctgccttttgattggttcatacatctgttcttaatggttctatgaaaattatattaaaaccacaacgtcaaggttttgatgagtagctcagaagcaacccaagtacaagacaaacattagaatataatgcttttcatggctagtgatggagtggggccatttatcatagagccaaaaaagcaaaaaattagagatacatcagcttccatgtttgagatttttaaaaatagctaaatgcttccaaatgtgcaagtttacccaaagctactttaattttactctgtttctatactaggaataaaagtttccaaggatagagtaatactttcttatgaaaattccaactgatcatactaaatatcaggtcaaaaatcctgtttaaaagatatgagatggtagtgattttcttgcatgtgagcaacatgaaaatataaagacagatcttaagaactattcaatcaacacgtcataaacagtgtgttcaaaatttagaaaatatatttgactatcttttgaatttaggctggttcagatagtaacctatcaagaaagaatgaaccagtttaaggaccatggaataagggaattaggtaagatgtaaattggaaattatagatagcactgattgcttaatgctgaaataatcaggaatacaaatttatcctgtgtcttcttgagtggttcaagtgcttctcccagatggaacactgaagtgccatccttcagcttcacatcgctaatatgtggagattcaagtagccaggtacaatagactcaaataccattattctgttattctaagatacataatctaaatacagaataataaagcaaatgaaatctcattataactttcaattataagattcttggtcattgtttgattttgttttgttttattttgatactgagacaaaattataactaatataagcaccaagtcaacaggaaactgagtattcactaagaatggctaccattccctagtcacctttctaccatcaccattccaaaattagttaaatcaagaaagaaaagataaaagggaaaaaggatttattgtttatcagttcttattccctatcctttcctgtttaatacaaatggtattagacacatggaaatttttttaaaaaatacgtaaagaaggatatgattgtatgaattggttctaccactttggagagcaatttggctcaatgacaaatatctccaaaacattatattgagagaaaaaaattgacagcatattaaatcttattattgggtacataccaatataagaataaaacatgcatgtaaacaataaacatgaaatcagaatggtgtttatgttggggaggaaaagaggagtagaatatccagagagagaaaaacacagaaatattttattatgtttataatgattaatatttttataccaagtgttaggggtgtttattacagtactattttacattttggcatttctaaaatattccataataaagtttgaagaaagcaagactatttagctagaagctagaagagtgatttagtttttatgtgaagcatgagaactagctgttttctgcctccataaatagaattggaaatttaggctaactacaaagtttactttcccactttagtgagttcttataggttgcaaagaaaatttatgtggctttctgtgaacatcgtgatgatgaggctggattcttatctttcttaaggagcttgggtggtcctggtttaaagtgggcgacatcgcccctctgctcctctctgactttttagttcttattgagagattacaatcgtttaagatgagtaagcagaaaagggaggaaagaagatgtatgagtataaatatcagagattaaagcccccaaatgaggccagataataaacatcagagaaatggtctctttcatttttgtcctttattgtagcacatttctaagccgactagatttatcttcaattttcatttcattcaatgttttgaatctttttttttattgtagaggcagtctcctggaaaaagaccttaaaaatatccccaaatattcagccaaatgacagagtcagttggaaagagtgcagtcattcacttttccatttctgtgtccagttgagattgttgcaggcaatgcccgtgttcattatctcttttactgagacaagatttaacctcacacaacatctggaaatatcagaccttttactttctggtatttctggatgagggaccacatgcacagactctattttgtaagtactgtataggaagagcaagcattttttcaataccatttatcaattgttaatgcttaaatttctgttttggtgtgacatttctgaaattcagcctcttctgttacatgtttagaaatcaatgtgcatgtttatatggacaggatggagtttgttttatttcttaccccctgaatatttgctcactaggtctgctaggggacctgccagttagagaaaatgaccattatgaaactaaggttttttgcattaattcgttatgcagtatagacatatttcccagaaaatcaattttgccaacccggaaataatgcaagcaccatgactgccaggatttttgtctgttgtgtgtgtggcttttttattcccactagaaataaacaaaaatcgttttgacttctcagtaatgaatgtttaacctaaatggtaagggatgaagtcatttttttaatgttagtggaagttggaaaatccagaagtgcctatcatataatctcagttatttctacaatagtacgaagtttgccgttttcttgcatcttgtacacacacacacccccacacacatatctgctaaggaggaaaataacatatagcatgaaccaggttattcaataacaatctggaaaatttctaacttctttatgctaggtcttccaaaatattagctatgtatttattcctgatactattctgtttcaatatgcttctccatgggtttggcttaatccacgtgtatatgcagtgcagttaaatggtagagatattttaaggctttttctaaatttctttcccaaacaataagacttcgggttcataagtgagcttcattcctctctgtctccagcatgataacagtaggatgatactcaagaccacacaaagaagaatccaagagaagaactagagagaaacaacacaagcatgagatcccagttgactggggaggtgacagtaatgtggattggactctggaaggtctgagtcttaattctgcatttgtcagaagtcagttgatgaactgggaagttacttagctcaaggagtttactcttcatctgtataaagtttgggaataaatagtctgaggttcttataagttctcaaattctgtgagcctatttctactccacttttataaaaaaaatagaaattatccaaagcaaaatgttgcccttttttaagacactttttcttacttttttttttaaatcagctgtccttcaggtttttaaaaaatctgtcaaaattatttttagttttagtaaaaaataaaactttaacttctaaattttaagaaattcttatttgtagaatcacaaatcaaaatttcctgagattctttagtttatttcttttcttatttattattaaatcattttttacaagatgcaaatattctacagcctgttcttttaaattggtatgtgtaattgttcagcatgttcagcttattaactgctaggaataaggctgtcattcattttgatcaataaaacaagtatctttactttggaggaataatgtatccaaaacaatcaacaaaggggcacttgtcaaccttttagctttggttaaaagaaaaaaagtagactcataacacaccactctcgaccacagtgatctttcccctgagctgcaacgattgtgaggcatattttgtgaaagcaactcgtatgctctcctccagtggttgccatctacacttcaatgtcctagtcctccagcacactgagatgcacccctactctcgtgttcctctagaaaaattattattataaaaacaaaatggactatgaaaaatagcctctttgaacacaaattaatttggagtagactttatatagttatgagtcaatttttcttccacagcaaaacacaattccctttaaaatataaacaattggtggattttataataattttaaatccaaaaccaagtaatacctttgtacatgtatatgtgttatttacacatgtatatagtatgtatatgttatttacatgctatttacacagaaacagagagagagattttaagaaatgaaggaatggttcataaaattgccggggctggcgagaccaaaatctgcaggacaggctgcaggctggcaagacctagggaagtgttaatgctgcagctccattctgaatgcagtctgaaggcagaatccccatttcattaggggactccagtatttttctttttcttttttttctttatacgttaagttttagggtacatgtgcacaatgtgcaggtttgttacgtatgtatacatgtgccatgttggtgtgctgcacccattaactcgtcgtttacattaggtatatctcctaatgctatccctccccgctccccctaccccacaacagaccccagtgtgtgatgttccccttcctgtatccatgtgttctcattgttcaattcccacctatgagtgagaacatgcggtgtttggttttttgtccttgcaatagtttgctgagaatgatggtagccataaaaaatgatgagttcatgtcctttgtagggacatggatgaagctggaaaccatcattctcagcaaaccatcattctcagtatttttcttttaaggccttcaagtgattagatgaggcccacgtacattagggggggtaatctgctttactgtgctctattgatgtaaatggtaacttgagctaagaaataccttcacagaaacatttaaactctgtttgaccaaatatctgaggactgtgagttgacacataaaattaaccatcacagtgctcaagctaaataacattattctttgctaatttaagaaataaactggccagtcacagtggctcatgcctgtaatcccagcactttgggaggctgaggtgggtggatcacaaggtcaggagttcaagaccagcctggccaacgtggtgaaacttcatctctactaaaaatacaaaaattagccgggcatggtggtgcctgtaatcccaggtacttgggaggctgaggcaggactccagcctagtcaacagattgagactctgtctcaaattaaaaaaaaaaaaaagaaagaaaagaaagaaactaacacatccagcaaatgtcagtgtggtacagaatctatgggtggtttaggaaatagttaccagaatgaaacttttctcctccacacattaagctttttgctctagcacactctataaatatttgtaattctgaaatgtttttcatgaattctgaaacaagaattttgaaggagcatatgtcttctggaataatttttcaacactggaaatactgatttacttatgctgtacatgaggaagttcctagaaatgcacttttaactgaaagtgttcaagggctgagggagagatgggctttttacattgtatattccttgattctaactcaattaatttaaaatgcagggagtttagtgtgttaataaaagggatttcaggtgttatgggaatagagtaaaatgatagccagcctgtgagggagggaacaggggaaggaggctgtccagggacctgcacatctgagctgagaaactgtaaataacatggtggttattaaagtggctcacgagttaggtcagctaggctcagatccatgctctggtactaaataattgtgtcttcagaaatttatttaatttttctagtactctgtcttctcacctataaacatacagtttccaaagtgtagaaggattaaatatgaaaagtacacctaacgtacctcacgccttgtagtcagtggcacatagtgattaatattattaattattattattattgtcactaggtagaagatgagggactaaaatgagcatgtgctagttacattgatttgttttcagtgtctacatgggattggatataggtgtcagaagacacaatcgaatcgtaaaagaagaagaaaaaaaggaaatgattttctgaaatcattgtacattttaatgtgtttaaaatgttaagtaggaaggatgtttttgtaagagactattctgtaagatgtaactttaggcaaagtacaattgcttttaataatttatgataggagatttaaatgttccagttaatatatctcttttagatagtcacctggaaagtagcatttttattctagagatgcctccattgaccacaatgtttttatgtcatcaatttttctgtttgtattgtttcgttagattatgtcttttatgtttcttcggtgtcaggaaattgtttacttttaaatgcaattctgaattttgcgagctaaaaaaccagctggaaacaaatagagtgaacaatatggattatgtatttttttagtttttagtttttggtcatgtggcttggttctgatttcaaggagtggctgaaaaattaagcaggaaagcaattttcaaggaagtttaaaaaaacattttgtggtagaatagttggaatatgtctttaatatcaaaatgtaacaaactggaagatacataataaataccccttgttttgtttttaaaataataatttcattaatttatatagaaacaaacatccttttattcctttttattgaatatatacaatttaagtaacattactcatggcaaaacgctaatggccaaaccagaaccctaaatccagcagcaaaaaaaattccacctatgcacgtgctttttcctttctcacacaaacttatactttattgacatcgaaaagatataatcttaaattaggatggacttattatttttatatgcacaaagtgtggcagcctttgcctatgtctaacatattggaaacatagttaataggagaatgagccctggaccagaagccagaacacccaattccggcccttgctctacacgtctcagagttatcaggagcaagatgcttaacctcttgatgcctcagtttactcatctataaaacctggctaacaatatatatcatcattccctccaaaagttgtcataaaaattaaatgtagttgtacattttgaaagtctgaaaaatgtaaaataccaaccaaatgctaggtactgcaatatatgttcttcatacctgggaaaaaagagtcccaactaacaaatgcattttataagcccctttatttctaaaattaagtagatgaattatatcccagttattttagtttgttttctctttgtcatcacatgtgtaaaaagttgacctgttttaactgtagttaaagatacaaaaagctcaggttttttgacacagcctttttgaatgtagtaaaatgcagaggccactcacactatcaaaccaattctgtaggttgaaatagtggtctacactaattaggtgtgtcaatgtagagagaaagtctgtatgctctgaagcctatctattcatggagtattatctattttacccacaaacaggaatttccccacaatgtactgtcatcacagagcaattaaatatatggtttgcatacttctcaatggtaaatattttgcctggttcataaggtcgtatatcatgcatttgtttctatttctggctagaagagatggatataataattatattcaataaaactggaatgtaatcccacctatggtaattttttttcaaaacacatacatatatatatattttcaggagagttattttattaaaataacaaaatttagaaatcagtaatttttttttttttttttttgagacagagtctcgctctgtcgcccaggctggagtgcagtggcgtaatctcagctcactgcaaccttcacctcccggttcaagcaattctcctgcctcagcctcctgagtagctgggattacaggtgcacaccaccaagcccagctaatttttttgtatttttggtagagatggggtttcaccatgctggtcaggctggtctcgaattcctgacctcgtgatccgcccaccttgacttcccaaagtgctgggattacaagcatgagccagataatttatttttaaatatcaaatttatagccagaaatttgggttttggtttgctgtgcttacctgtcctgaattatagtagaagcaaaataaaatattagcatgttttaacctatttatttgttctctcaaaataacatattttgaagaacatctatcaccctgctaactaatgcttaattattcattaataaaaattctttataacttgaactttgttgactaattattcggactacgaaactccaccaaatattctcattaatgtaactcatgttttggatgtaataaaaatagtgaattctgtaattatcccaggtgctattaacatttgttgaacatgcagagcaaggggactacagacttctgccaacacaaagacaagagaaatttgctttagcaaatttgccttctatttctttattcaatctgattgagtatggtagcaagacaaagactttttttctgtttctggtgaattaattgcattgttagtgtttcagaaccatatgaaacaatttccctttaaattaatataaacgagaaaatgtaccacagtctctttgtatcttttgttgtttctcctttagagcccaatgtttcatggcagtcgagtttctggaattataaaaagtataaaattattttaaaaacagtaaaaaagattgtgtatacaaaaataattcttctaaacccattaaaaatagaattacctttctctcagaactaataagcaaataaaactagctgagattacaatcactcgatgtaaaaattctaatcttacatgattcgaagacaaatatttttcccaaaggcataacaataagcatatccaaatgttctttccagcagagaagaatgaaataaagctacactctataaacttcagtgcacgatgtgtcaactcaaggattagtgtgtatttcagaaaataatattgaaattcgtgtttttattacttagaaaaattcacttctgtaagtcaaatttattcatatctttttatttgtttactaaacgctaaaagacttcacattaacatcatcacaaatatttagccaagaatgccagctgttgattatgggcctatgacagaggacttggcatatttccaatcagatgcttctactgtatcccaaacagagcattttaaaatacagtgcttctctgctaacggatgttaaattttcaaatgagcatatttgggagaatgcatctacgtattgacacaaaaccaccagacatgggcattgacatacagctgagaggcaaggacatctcctaatgatatggcactgccaaaagccagagaagatgggagtctcacacatacaaactctcatatattcatgtccagaacagtgatagctcgtatttctcagtatttgccctgtctagctaagtgatttatattgactagctcatttaatcctttgaggcaggaactattcttctcaccattttagagatgaaaaaactgatggcacagagatgtcacattatttgtccaagttcccaaagccattttaacttctaagcccacactttaaatcactatgctatgaagtgctatctcacacacactggaattcagacacagggaaaaaagatcccagtgagacaattgcagcatcagattaggcatatggtacttcgagagtgccttgtctagcatgaagtcagaaaacaagttgagtggcctttatcgctctgagtcttccgtcttttgtttaagcatcactgtgcccagagttggcatttatcatatggctacatttaactaaataaaaatatcatcctttttcaacatatgaaaatccccaaacttcaaagttgactccaaaatgtgcttgtttttaaaaattggcactcaagtatttagggataaaggctctttatgtcggcaacttattctcaaacaagtcagaaaaatcactcatacacacacacacacacacacacacacacacacacacacaaagaaaatctgataaaatattaatttgggaatctaaatgaaagtataggataattctttgtgctgtatttgtactttttctgtaaagtctaaaattaaaaagctgcctggagattcgaatagtcaaaaaaaatttattgagaaacagcaataggaaaattaaggatacaaatatatccagattggcatgtccaaaataaaacattactcatttttttccggcacatgtagaagactgcttaacaccccctatcttttttgcaatatagactagaagagaaattaagacctagattatgttttcctttctacctaaggcctctatttcggttctagctttctatttgtggggttttttccccttctaggtcacacaatctcctttctacaagactgagttgcatttgaaagttttaacagataaacaaattagaatgcaataaaatagccctaatatccacaaaagaaatataatagattcacctttctacattgaggctaaaattgaatttcaaggcattaggtgaattagtgtatagccaaaactatcctagaataacctttacatagcccatcaagtaggggatcattgttttgtatagtaatgattatgcacagtaaattttgacaaccgctaacctgaacaaaaggaacaaaataaaaacttacatgcaaatgtctaagcattcaaatgattttgcttttaagataattatcaaatcctcagcagtataaggtgaggaataggggggcagtgagaagaaaattttaagtgattttgcttgatgtaaactttattccatttggtttcatgttaacataatatatgtaagtagatttgtttgtcagggttaaataagagtacagagataaattttgcttccagccatgaggaaggaactcacatcatggtaggccttctgtcacaagccattgtaaaagaggacaaaatgtgtgaaatcactgcttttagacattcagcaaaagacaccacgtgactatgatccctgaaagaagggcaaaaacatgagatgagtcctgtaattgtaccagctttctgcctggtgtcacttcctaggctgtggttcagagatggtgcccaaaccaacacagcggtgccacatagcagaggagacagagattagaattcagggccagtgaggtgactggaatttgtattgcaggatcaagagagaagcgagctgagcagaggaggagttccaaaaatctgcatagaggtccctttgagtctttgaatagcaagctgtttatattcagattgaaactctctgaggcaggacaaagtataactattaggaagagaacaaacacaggagaactgtgagttgagctctcagagctagacagagtgtggagatatttgcattctgacttgccaaagtgaaagcaccttactaaacactgtaggtacaatattgctatagtttggagctttgtcccctccaaacctcatgttaaaatttgatcctcaatgttggaggtggggcctaatgggaagtgtttggatcgtgggggctgatctccactaaatagattaatgccttccctgggggcaaggtgagtgagttctaattctattagttccctgtgagagctgcttattaaaaagagcctggcacctccctcctctctctctctctcttgcttcctctctcaccgtgtgatatctgcacatgccagctccccttcaccttctgccattaatggaagcagcctgagactttcatcagatactaaatcttccagccagcagaattatgatccaaataaaccttttttctttacaaatacctagttcctagtattcatttataacaacacaaatgaactaagacaagcgacacaaatggactaagacaagtagaaactccacacaggccataccttagaagtagggctaatctagtcctacaagaaaggttattcttgacctaccttaacaacaagacttgaaagtatcaagctcatctacaggtaagttaactgcctatgggaaaaaaacttaacactcttattaaggaagatgatagaaatccagtcaacaatgaagtatccataatgtttaatgtataattttaaaatgaccagtcatgcaaagaagcaggaaaacatgatccattgccagaataatagtcagtcactcaacaagaacagacccagaaatgacacagataatgaaattaatagacttgtctttaaaataactactataaaaatattcaggaatttaaagagagaagacaacgaaaaatagaaaatctcaactgggaaacaaactataataagaaatactagagataaccagaaatttaaaattcaccaaataagcttatcagcagattaaatactgcagaaaaaactatcagtaaacttgaaaatagagcaatttggaaattacccaaactgaagcacagaaagaaaaaacagctgaaaaatagtaatggattatcagtaacttatggtagaattgcaagcagatttaagaagttaaacaatgcctaagcaggaataacacaaagaagaccataccagggcctattaattagggttccatcaggtaagtggaacgactataagtgatgtacagtcagggatttattttgaggattagaccttaggcaattgtagaagcttcttaagtggtctatataaggctatcaactctgtgctaacattaggcctgaagtcagcaaggaaatatagacattaattaagggggatccaagagtgaaccctgagggaacttgtgggggaaaagtgaaatctataaggcaaaactagaacccacgagaacaaataggaacatgtatttgtcccactccctccaatcttgataatgtaagtgaactgaaaacaaagctggcactcttccctgtgaaactatacatgacttggcctgggattcaaagatctaacaaagtatttctggttagaaaaactaagcccaggttttgctccccattaccagtgaggtaaaccagtagatcagtaacagtatgcatgagctacaatagtacctcaccccgtgccaaccttcacagtgttaaagaccagctgttacttcacttctaccttcccaatctcacacaagtttctgttgtgacccatcataaactggaatgatacagtgaaaggattcctgagaaacattccagtttagctatactgaactgttgccacagtccacccccttacaacttggcactcccatatacacctttcaacaatacttaacttctaaatgaagacaatagtaaaattatctttttacatagcacaatactgatatatactaaaatactgatatataactaaaaacatgctaaaactctctgaaaagatgatacaaaatccctttattcaattttggttaatgtttatttttcttctaatcgaatcacactccccctaagatatattataacttaaatactgaaatataagctcagttactattaatacttcctatgttatatgttagggagatggagggagggaaaagatagttggatggagaaaaaaatgtataaatatcttcatataaaaataagaaagaaattctcaaatattatggtgttcatttctgcagctggtgacatgatttcagttaatatttgttacttcagtcttctactacccactcctattccctttgtcttcagtaagcactttgcctggtcataattctttgcctaatggggtaaaacaagccttcatccctgaagtgagataaactgctaatggcccagccatttgcagttttgctgtagtttttctttgactcttatcacagagcatggaagtattaagatgtgtcccaagatattttgtgaattacaaacacattcctccttaccaccatagtgcagtcaaaacttaatttcctcttgatggtcaaaatcagtcattgcagtcagtataacctccccttctctgcccattgatttaccaccatgagaatccctaagtggtcatatgacagcgtcaaattttcatgtaatagaaccattgctatgtcccctggtggaagcattcctctcttgagaactaagacctctagacaagatgagccaaggttgcatagataagaagcaataattttgttagtaatggattaggggtaagcaaggagataagccattcactttcatttccacttcttgattcccagatctgtgtaatgagagaaaaacactacaaattggacacagattcagagcatatgctctattttggatgacattactcaagccctacaaagtgttgccatgcatctggcaccataatttagtcttcaaaaggccattctatcaggccagctgcttcagagtgatggagaacataataatacaagtgacgtccatgttcacaaggccattgctgcattttgttagctgtagaatgagtttcctggttagaagcaatgctgtgtggaatatcatgttggtgaatagggcattttataaatccacagagggtgattttggcagaagcattgtaggcagaaaaggcaaatgtatatctagaatgagtttccattgcaatgagaacaaagcattcccccttttatgttagaaataattaacctacttgctaccaagtcacaagctggtcctcctgggggctcagtatccatctcaggtagcaggttgggcactcagcagtggcagttgtcagatcagctttgatgagtggaagtgaacattgcttagcccatgcatagcttccttcgctgctgcccatgaccactttgtttatgagccaatcggacaaagatagatgtagctgcagaaacaagttcatttatatccatagaatggaccactatgcccacttattcatctgaagtggctctttggtgagccttgatatcggacacaaatatcttcatgatctatgcctgatgtgatctatgccaagattcacatacatctttccagacctcattatcaccaagtcaccagtcatgttccttttaattgagaatcattcagccaaactcttagccacaccgtttaaactagtggatatctgaccatatctcttcctccagataaaactttacccaaggattacaacaggcaaaaatatatttttttgtgttttaatcagtgctataaaaccaggaaataaaataaattaaaaacataaatgttggaaagaaaaaaagtatactgtctttattcaaacataacatggttgtgtatggtaaaaactataattatctaaaaaatatactactagagctcatacatgattttaacaatgccacagacataggttaacattaaaataaccattgaatttctatacactagcaaagaatgggaaaactaaataaaaaatccaatacaatttaaaatagtatcaatggacacaaaatacttggaaaacttaaataaaatatgtctaagatctgtatgctgagaataaaaaacattgctggaagaaattaaagaatatttaaataaatagaaatatataccattttcatggatttgaagactcaatatttttaagatgcattttttttttctaaattgatctgtagagtcaaagtattcccaaacaaaatcttaggtgtatttttattttggtagaaattgacaagatgtttttaacatgtatatgaaaagaccaaggctgggcacagtggctcatgccagtattcccagcactttgggaggctgaggcaggtggatcacctgaggtcaggagttcaagacaagcctggccaacatggcaaaaccccaactctactaaaagtacaaaaaaatattagccgggcatggtagcccgtgcctgtaatcccagctacttgggaggctgaggcaagagaatcgcttgaacctgggaggtggagattgcagtgagccaagatcatgccactgcgctccagcctgggtaacagagtgagactctatctcaaaaaaagaaagaaaagaaaagaccgactactcagaatagccaaaattatcttgaaatagaaaaatactttgtagtacttatatcacttgatttcaaaacttattaaaatcaagatggcatgatatgatgtaaagatagattaatagtttaacaaaaacgttagtgagtccagaaactgaaccacatttacccagtcacttgatcattttttaaatgagtcatcaacataagttaatagggggaagaaaagtctttttgacaaaaggttctgtaaaaaatgactacttataagaaaaaagttgcgcctcaaactctgcaccattcataaaaattaattcaagaaagatcatagtcctgaatgtaaaagataaaattctaaaacctcttgaagaaaacatagcagattatttttgcaaccctgtgagagacaatccgaggccctgaactgtgggtttccatgtctgtttttgcattgcccaattttagcaaaaattctgtcaaatttgtttaaccagaatctctcacccttcatatctgatcattgtcaatatttgaccaaattccttatctcccaccacctcccagatgatatctgattactctgccctgacttcagcaagaatcctgttaagctgatttaaccagaatcccttcttactcctcatgtttcctcttagtaattttccatccactgccccaacttgcttcttgtctataaatgctcacttgtctttgctggactttcagagtctggaagtccaagatcaagttgtgagcaggattggtttaggggctggacatggagaatgtgccagtacagtggtctctgatgtccctttttataaggacactaatcctgtttgatgagagcctgtcaccattatgacctcgcttaaccttaatttcttccttagaggtctcatctccaaacaaccacacaggggattagggcttcaacatatgaattttggggagatacaaacattttgtccatagcagtcataaaaatgtcagtttggattaactctaaaataaataatgcattgttttacttagtaagaaagaaccaatctctgattctcaaagcttgggttctcatcagcaaccgaggccattgagtcaaatagaaataattacacattcaagatgttatctaaatatgatacaaattgaatattagcgtaacctactgacagaagcttgccttgttaacagtacttacttacaaaaaaaaaatttgagtgtcttctatgcaatacccaatatattaggaactgttattaaatgaggtataatgatatgataacaacaagccatatggttacagacatacttcactagctgttctgcaggatgagcatgaacagtagcgttgtataaacaatttagcattgccaaaatgaagtagtgatttgaagtgattgtatggatatatcaaaataaaacttgctaaatggagtaagacaggttttagcatgaattaacgacataattatttcagcttatactttagctaccaagtcctggcataggtgtaataggatagagtgctaggaagcacaagcctctaaaagtgagaactcagatgttcaaacacagaaacccaacaagcctgaaaaatattgccctacgagaaattagaactccaaagagttgctttccaaagttaaaatttctgtggtacaacattttcattctcatgaaaatgataacttcttagaatggataccaaaaaatagcaactgggcacagctggatggctgcctggtctttagtgcaagagtcctgatgtttttcagacaagaggccagttgttattgagtttcagagagaaagaattatttagtgcaggtatactccttacccatttgtgtatatgcacgttttatgtatagctctgttctataactgagagcttatgacagagagtcataagtctcttgaagaagcaggaagaagaaatgataaaagggaagccaaggaaagccctgcctgacaaatagaacacctgtcaggtcaacgttccatgggatctaacagtacacactggtgcaggcccaattagctaggcaaatgatttaggtattaaagggacataagtcatgagaacagagtgttggtcaaagtcaagtttaaaaagtgagactttccttcactaatgaaatatttcctaataaatttcctaataaaatatttcctaatgaaaaaggtaaagggtattaagaatctttgtttttatttatttatgtattagagacagggtctcactctgtcacctaggctgcagtgtagtggtgcaatcacagctcactgcagcctcaaactcctgggctcaagcaatcttcctgcctcagtctcccaagtagctaggattacaggcacacattagcactcctggttaatttatttattaattttttttttttttttgcaagtacagggtctacttatgttgcccaggctggtcttaaactcctggcctcaagcaagcctcctgccttggccttcaaaagcactggaattacagccataagtcactacacccagtcaagaatcttttcaaactgatacccgttacaaggaattttaaccacttggactgccagtctgataaaacttctgtaacagcactagcatgtgaatttttgtttgttttttaaacagagctttagttacgtagatctgaaggaacgagatctgtagaaaagccatttgatccagcactcaaataacagttcttgacggaaagaatgaagttctaaactataattattagccaaaatgtcattatacattttaaaaatcccatctttccagacaaaatagttggaaaaaaagaaatgaatccaataaagcattgtctctaaaaaattcattggtactgctagcatgatttttaacataattcatttaagattttataataggtaaactggacataggaatgctgccatgtttataggccgctcaataggaaagatgaaactcatcaacaaaggcagacatattgcagccacctaaccttgtctgccacataatagtttccctataaagatttgttgatgcattgactgcttggtttaaaggccctaatagtacagcattaatttcttatgaagtactttctaatatcttgcatttaagttttaagtgtaacctttgctatattatgggactgactcttttattgcattaaaactaacggatgcatattgagtaattagctttgcctttctttctatactttctcttaaatctttataagggatagcacgggaactatatttttatctccaagtttgcctccaagtccagctgtgtagtgaaagggcagcaggaaacttcatgaagtatgccttcagctcagagtcagaacccgcattcagaactttgctggggatgagagaaaggtcaaacctgtgggttaaaagagaaagagagagagatgagaaatttacagatttttatgaagaaagctacaataatttgtgctctggacacagacggacttgggttagggtcctggctgtaccacttaacctacataggcttagtttctatattaataaagcagggctgatggtgaatataaagattttaaaggctctagaatatagcaggcactcaaaaaatgttacagttattattccaaagaacatttggtgacataaaaacatgaggataaatatcatccaggaaaaatggaagattctgcgtaggtgatagtccaaacaccattcagaaagccagtgcatgggcaaattgctttggagccacaaaaagctaggaattaatgacgtcttgggcttcaaggaaatagtggggagctgatctcccacaggtgtgggagcctatccaaactctctgttttcctccgtgtcctctgactgatgcccaaatccaacctggatgacttgtcacacctgtgacactagcacccacccaactctgatactcaccagtttagcaaggccctcttccatgttcaggtacctaaactccagaccccttgggacacactgacttatactttggggcactttgtcccactggaagaatatgggagtagggagaatagagaacaatggtaagagaagcttactctcccagcctcatcatctccggctttctctatcactgaaccctttcctcatagactctccaggtctcatgagcttgattaggcgactcatgaaaaattctcattactgaagcctgagatttctcctttgcctgccagtcaccctctgtctctccagagtcagaacgtttgcaatttccatctcaatgattattttaacaagtgaattaggtttgttgcccactctgtagatttaggaaggacccttatctatgagtgatttcggtctcacatcccaaaagtccacatttctacttcagcaggccacatcatgtttgttccatggttcagaatatctgaacttttagtttagaactggctggtggggacctggagttcatgcaggcagtctgctctggagtctgcgtccttattcccattctagtccacatccctctaactagagtggatggggaggggagaggaatggaacaaaaaaggtaggttaaagttggattgaatagaatcttgaaagctaaaccaaagaattagaatcttactatgtaggcagtcggaattcagagagattaaacaaagtggtttttgaggaatagtaattggttggcagaacacaggattgaatagaataaggaagatattaaaagattaagagactgtttagaaggtattacattaatctaggtttaacaagatgaaaactcagcctaggaggtaacattgggaactaaaaagaagtgatgggcatgagccagttaacatcagcatgacctggtgggtgattggagtggagagtaaaagcgataagtctggttttaagagtagatgatgaggagatctaattacatacacacacccataactaaggagttgtatctgataaattatttaatctgaacctaaatatttttattccttaatttaaacctcctcccttttttatcttcagcttaaacattgctgtttaaatcctccttaacactttacgcttaagactaaatgatcctgatattgttttttctcattcctccacttcttaaatacatatatatatatatgctaattaatgggcagagttggtatgcatgtactgtctatatctctataggtgaaagcaaaaaacggattctggagataaaaataagaatgatagctctcctttattgaacacttattatgtacctacttctgtgctgagctgctcatatgtattatctattgaatgcccataacaaccctaagaaatagataccattattgtcttcatttgcccaggaggaggctgaggcttggaggagtataagaacttgctgacagtcataacatctgaaggggattagaatatgtcacgccaaaatatgccactttggcataataattattttaagttgaaggcaattgagaaaaagcagacacaagaagagctcttttccctcccctatctgcctaaacatagggcataaagctttcttgtgaaagtatttccccaccttccatatcaggaaagggataacaaactgtaccactggaaatggagacagcacctaaataagtctgtatagacaaaccttactacataacctttatctagcagttaatttcccccatatatttaccttcccacaatttgccactcctagaaagccaagcccctttcttttgtgtagtcacttctccataatttatcactctttgttaaaatggtgtataaggccaagtctagtcacttctttgggctgtttccttctgtttcttcaaagcccatgtacatgtacaaagattaacatccagtaaattttgcatgcttttcttctgttaatctgtcttctattaatttaattcacaggccccaactacagaagataagagggcataggaaaagtttttcctctctacaagccaaaagtcgcaaggctaatatttactcccctgattctctcctccagagcccacacccttcatcactactgataaaggtatgataatgaattctaaattcctttcttaaaatctgctaattgggtaaagaagtaaagaaaagtttgatattctcctccatataatggcttatttatagctataacttacttgtcaaatacaaatgctaccgtggtactatttatgtgacacgtgatccaaagactgttaccacacactacactaaaacatggatatgacatatttcctgtgaagaagaatttggtatgatttagaaaatcttgaatcatattcaataacttaattttttatccaggatataaacatataattgtttcaaggtataaactcctgtacagaatgtcagtgtattatggcacaccccataaagagactgtaaaaaacaattatagttttatgctcaattaaagagacggaaatttttaaaaggggctatgtcaatcagaaagaaaagtacctagggctcattaatttaaagacagtaattgatacgctggcttcaggagtgtttttcatattatcattaatcaactcttcatttgaaaaacacacacgagggaattactgaaagagtaggtatcacatttaattttttccactatgtttttcctagtttcaaatatgtttttcaaatctggcattcatggttgctactgcactggaataatggtaacaacaggctgatgagaatcttaagtggcacttactcagtggagtaattggaagcggcaatggttatacaaatgaatgcccctcagagggaagaaggagagatttgccttgaaactgcggctgtaaaaagttagtgctggtaagtgaagaaacagaaactaagtgatagagaatgggaactaaggtagaaataactaacaaagatcactgtgcagaaccgtagtggtgttcagagtagatgcgcaagtccatatgcatgtagcaaatacaagtctcaacccacaaaataaagtgaagatgaatatattttaattttgttaataaagttattttaatttctgttataagctctcttccaccaagacagaagcacggtcacatgcctgggtaaaaagaatatcccagatacccaagactagacagcatgcaggggtgacaggcttattaacttcacactcactgggccatcagtactttacttataacctcattcatggttttgaagttttaaaaaaatgttgccaccttgttattttgttactcctctcttataagtgattttcagataagcagaaacacattaaagggaaagtttatttggttcatttgcaaggcagagtccatggatttcttttggctatccctttttgcactttcaatggaacaaacagtgcaatttttatcccttctgtttttagagcagcagctgtaaaagtaattaatggctaaagagactctagcacatcctactgaaaggccattctgggttcagcaggagctctggaccccaggctcctgcctctgcacgttcacagacttgcagagagcactctgatgaatgctgaaggacccccctcccaaacttgggatctccgcagcaccctgatccattttgaccactgccacttataaagaaaactggtgtcaacaggtgttttcatactatttccagtgatgactttggtgcatatccagtattcttttttttaatctctgggagttgacaatgttctcatgaattctattaaaaaatgagcatttcccctaatatgttttctcttcctttcagccttcactttcttctttttgtctctaccttccttaaaatagcattgtgcaaaaacatccctgaggttaaataataatcatgtataatgaggaagcgttctgtgtgtgccctctgcagagtcagaggcctgatgtgggactgaaaacacaagctggcctccaggcctggtgagggtcatgctccctgtgacctcgagtcaattgctcgacactttggattctcagttttctgatctttaaaataaggatgacagtacctacctgggctacttcacagtgtccttgagggatcatgaaagtgagtgtattttgtaaactgcagtgttccatagggacataaggaatgttggtcttattgattttgttagaacaagactcttcagaaacagtggtgagagagaggaatcagtccgggattcctcttttccatctcattgactcatctgataacactgagatagtggcttgctgctgcatattccctagcggactgagagaacacacatttgccaaatatggaggggaagatgagctttctgaacaccctcctattgtctgcactggagctaagccaggccacatcttcaggataatgatctgaggacggtcaggctcaattcattctgcctgagctttgctgctgccccttcaaactacttacgaaagtggtattaggttgtgatggctgctgccccacccttgggagaatgcccaggggatgtggactgccctaggcagccacaggaaactggaccagaaagtgcagagtcactgtgtgcccaggcgcctgcaggcagatctttctccaccacatacatttttagtgggccctctcacaaatgcctgatatttaacatttgagaaagtcagcaaaatgttttgttagtcttttattcaccattttaagaatataacgtttatccagttggtgtcggataaaatcgggaaagaaaaatatgactgcactatagactcagggcccaaaattattctgatgatggccaagtaaaaacattaaaagctgaaaaatataatagcatccaggatattactgaagattagttttaagcttaagtttttttccctcacttatccagatttgagtatgagaagatttaaagaattctataaaaactgtgaaaatgcatctgctaaattaataacagtatttatttcacaaaaatgtcctaagttttgtaatgcctctaaaacaattctcaaacttcttggtctcagtatccctttaaaattcatacattacttaggaccccaaagggcttttgttcatgtaaataatatcaatatgtatttattgtattaaaagttaaacctgagagtttttaaaaatttatttactaattcatttaaaattaacaaaaacaaacatactacctgttaacatcagtgcaatgatgtcgtcatattgatgccggatttcttgctccttagctcagctaggtctgggttcttgtctcatgaccaggaagaagtaggcacctgggcactcttagagtgagcaaggcaggaaattttattgagtgatgaaacagctttttcaggaaggggacggggatggtccccctatccaaaggcaggagagttctcaatataaccgagcccagggctttttaagggctcagaatagggagtgtgtgctgactggtttgtgagtatgcaaaaaaggtcaaagcaaagatgccactcaaaggtgggcacgacattgtagaaaatcaattaggaaagggtaggtatgtgtaaaatgggtgaagggtggagatcaatcagaggaaagcacaccaaacaggaaagcgggttctcaatctggttcgaggagttaacttgtagcttggctttcaggctttaaactgtctttggcttggacgtgggatttcgctggggacccgcccctacatgcttaggcatttggctgcctcctgctgctctcaatatttcatatagctatggaaaaactctactcataaggaaatgagagtgagaagggcaaatgacttcttagtgcttgcttgtcaagggcttgtttgacaatgtttgctctaaaatattttgatctccatgaaaaaagtgttaaagaaaatgaggaattacaattttattatcctaggatttttaaaagtctgtttcattgatcttaaaaagtatatttgtattgttcaaattgtgggctatgagtttgaatcctcatcctgtcatgtactggttgaatgaccttggacaagctatttaagttttctggacttcagtgtcctcacctgtaaaataaaaatgataattgtataccttccccttggggatgttgtgatgagcaaattacttaaccttatgtatgtcatggttgtctagagggaaaaaaacatatatataaaatattggatatgttctatatatgtgtgtgtgtgacagagatacacacacacaaacacacacacacacacacagagatttatgttaaggaattggcacacgttacggaggctggccagtccaaaatctgcagggcggactggcgcctggagacccagggaaaagccagtgttgcagctcaagtccaaaggtcatttgctggcagaattatctcttgctccagggaaggttaatcttttgttctgttaaggccttcaactgattgaataattatggagggcaatttattttgctcacagtccaccaatttaaatgttaatctcaaaaacaccctcaaagtaacaaccagaataatgtgattacatatatgggcaccatgatccagccaagttgatataagacattttcgttgaccaaaaaagccaaactctataaaatatttgaagatatttattctgagccaaatgtgaggaccatgatctgtgacacagcctcaggaattcctgagaatatgtgcccaaggtggttgggttacagcttgattgtatacactttagggagacagaaattacaggcaaaaacataatacatataagattcacattggttcggcctggaaaggcaggacatcgaggggggccggggagtgtgacttccaggtcataggtaaattcaaagatttcctgattggcaatttgttgaaagagttaggttatctaaagcaagcttgtccaacctgcagcctgcaggccacatgcagcccaggacagcttttaatgcggcccaatacaaatttatacacttaaaacattatgaaatttttttgtaattttttttttttaagctcatcagctatggttggtgttagtgtattttatgtgtggcccaagacaattcttccagtgtggcccagggaagccaaatgattggacactcctaatctaaagagttaaagtcagcagaaagaaatgcttggggttaagacaaggggggctatggaagtcaaggttcttgttatatagatgaagcctccaggtagcaagcttcaaagacagtgatcatggtaaatgtatcttatcagatcttaaaatgtgccaaactcttaattaaatcactcaaggatcaggaaaagacctggaaagggaaggggattctctacaaagtgtaaattcttcccacaagagatagctttgcagggccgtttcaaaatatgtcaaagaaatatattttggggtaaaatactttgatttctttcagggactgccatctgtcacgtgatgctatactagagtcaggttggaaattggtatcttattgctacaaagagtctgtttcctcagtcttaagatctctgttttaatgttaatgtgagtcgatggtgcctgaattccaaaggaaggagagtataacaaggcacattcaaacctccttcccatcatggtcagaactagttttttagatttctccgaaatccctttgactgagaggatggggtccattcagttagtaggttggggggctcagaattttatttttggtttacactttgaatggtgcccggcatatacaaactctaaacaaatgttatatattcttaatattgtattgaatatatattgtttttaggtgttgcatgaaaaaatcaagtaatacgcaaagcaaatttttatttttatggagaaaaaaaccataaaacccaggaaacaagtaataaaggttaacatggctttttatacttaataatacttcatattttgaattaatatataagaagattcagaaaaaccagtgggaaaaatatgtaactgttgatgaaaagagttaaactccgtacaatatttgaagagatttattctgagccaaatatgagtgacgatggcccatgacacagccctcaggaggtcctgagaacatgcatccaaggtggctggggtacagcttggttttatatattttaggaaggcatgtgacaccaatcaaatacatttaagaaatacattggtttggtccagaaaggtgggacaactcaaagtgggaggctttcaggctacaggtaaatttaaacattttctggttgacaattggttgagcttgtctaagacttgggatggatagaaatgaatgttcacgttaaaaataaaggattgcagagaccaagttttattgtgcagaggaagctctcagatagcagacttcagaaagaacaggttgtaaattgtttcttaccagacttaaaaggatgcctggctcttagctgattgtcttctggatctggaaagaaaggaaggaaaacaaaggggaaaagggattctctacagaatgtggttttttcccacaagggactttgcagggcaatttcaagatatggcaaggaaatatattttgtggttaaatattttttcctcatcttataatgttatgccagaatcagattgaaaagtcacaaaatatagggtcaaatgaaatccatctgatgagaacttatggtttgtagggcatgactccctagaccccttaggtaggaatttgggtaacataaaaaaatcagagcttagtcctcataacccagaaacaaatcttatcatatacagtgatatgataaaaattggcatcacaatgtgaaaggtgagttaatcattcagtaaacagtgtttaaacaattgttaattatttgtttaaaaaaattactttatatcatcactttaaccaaaaaataaattccaattctatttaagagtgaaatgctaaacatacacatacacacacacacacacacacacacacattacagaaaataatttataaatttatctatatctatatatagataaatatttagcttatctttgggtaggattttaactcagaaatcattggaaatattactaaaacattaaaacattgattacattaaaattaccagtgttaaaggtaacaaattgtgaaagaacatctacgcaaatgtaacacagaatcgttagtatatgtaaaatattgcaggcttacataaattgataggagcaatataagatcccactggggaaaaaaatggcaatggtatcatcctggtctgtcagtttcctttgagtcacaaggataatagaagtacagattctttaaagtaatggaaatttatgtagaattcctcagaatgcagagttagagagaaaatcatcccttaagtaacagtcatctgggaccccaatgtcatcttaactgggataaagtgttggcttcaaagacaattatgagaactgtcttgtttaggacaatctcttgtttgcctttcatttgtacttcataaaaactgaacatgattaaattgtttggtaataatagatggattgaagaaattgattcatgggaatacattttggactagatttgtcacacccacaaatgaaaaatggatattttctagactttcacttattttaattgatgcacaatggcttatttaaaatgtttcagccttaatcctccctctccctgctttttgtgagattttctggtctcaccaactacagttctttccaggtttggggatggaaaaagcgtggtaccttttcatcccatcataagggtcacagccaacactcctataacaaaaaacaggttaacatgagaaaagcataacacatttctttaatcaaagttttatatgacatgggaggcttcagaaatgaagacctaaagacccagggaaaactgtctatttttttgcttaggatcaatgaagaatggacagccatgtagaaatgtgattggaccaaaggttgtgatctaatggtgataggttgcaggggaaacccagcaaggcctgactgttcagattcttcttggcctctttgtgtggtatttctttctcctgggtatgcagcaggacccctctggaatgagggtcttatgacctgctttcaagcaaggtaggtcagatggcttccttgtggccagctcctacacagaaagtttagagcaatatttctagtttctatgacccaccttgggaaagaggaattctagtttctatggcctgccttggggaacaggaaaaagaaaggcaggagaaagtcagagacagactttgattctgagacccttccaatgtccttcggtttaaagcactcagcatgccaaagtgccatgctgaggtggttcagaaaacccccaacacaggactgtgagctcatggctggtggggacttactgtctatgtgagtctgtgcctcacacaagtgcatcacacccccatgcctcaacaccacatgtaaagacaactcccttgaaggattaattggcactttaaaaaggatgttggaacagagaaccaaattccggatactttctttcccctactatttccacaagaggcaccatgcaggttgactcttagccctggttgtcccaaaccagaatgaaaggtctggcttgactcatggagattagcttaggctgctgggcaaaagaaccaaaccctggtcctgactgttgcattggagccttctgtgtggtctagtggagaaaatacttgctgggagccagaaattgagatctgctccttgtccagtcttcagagcaggtggcggggccagctttgccagagtccaagtggggcacttatgtttgcagccttcagatttccctaaaaatagcaagacctctgcatccatgtatcttttggttgagtctcagtcacttgtaagcttcaacaattaaatttacctccctgaacctcaatgttctcatttataaaatggaagaactgcttacatcatgccccttaagaagattaaataacattgcactgcgcacatagagcatgtgtttggtgtataataatctcaagaaatgaacttctctcccccttaagcttatgtcaccatcttgtttcctaacagatccatttttgattaattttcagacaggaaaggatcatatatattcaaatggtgttttattagctaataaggcaaactaaatgttctctcccaagcatattggtattttaatatggaaaaatgggaaattatgctgtcatggtgatacctgaggcagcgaggagaagccaacaaggactgtatccagagattcaggagaaattatccaagaattctttgcttcatagcatttttgaatcaatcttttgatttaagccttctgaaacttaacttgccaatattttgaaaagtgaactatcaagattgttgtcaatcacaccctagtgtggtttaactttcagatccctttttggaagggaagttttatttaatccatgtgttgagaagaggaggatgcagttcatataacctggatatttagagtgaagggagaaagaagatacagtgaatatgaaatgaaactttcacataattcacacatgtacccagagttgcaaggagaaaacaaaagtattggtacataagtacttttacgtgaaatgatttaaaatgtttgtatatggtattttttgttgtagtttctgagatggagtcttgctctgtccctcaggctagagtgccgtgccacggtattttaatttatttttctttattttgaatttctctactcaaaggtacattttaaatacccttaatcatcatgatgatcccacacttcctgcagattcccatagaaagtcacacatcttcctcctgttgaactattgctccacaaatcatagtatttgcctaggattttgctttttaaagttccattgccacatttgtggtaaattctattgtgtatggtaacacatgataacaacaatgcgtagcgcctaaaagctctaatgaccagcaattctgtggtcagtaaaaggaaattacataacattagtagccaatatgctgttgagggaaaagtcctcacatttctcctgaccatccctgcccctgtcacttgccactaatagtaggttttgcaactaggtttgggggtgagtggaccctggagtactattctctgtacccccaaaccatgcccaacccttctacttggttatttcaactcagtggtggtcaagttttgttgtatttaactcctacacaacttcactctgtctgttctatcataaaccatgtgtgtctagtactatcaagctaagcattttcattattactttatttacataaaacccttttaaaagaataatttgacctaagatacaggtcatcctggactttccaccatgtatgtctgttagtggtggtttgtcttttttgggggggatattttgttttttgtttgttttgttttcaattttttgagtatttactatttaaataaaaagcaatggcagcaaaggtttctatttccatgtccctttgagctttttccttgacatccacttctctcacaaggatctggccttcatgccaagtctctgctgatcttcactgcggagggcagctcctcccaggagagggtccagcccctccattggctggtgccggcctcacatttgtcctgaccctgtgtctggcttgtgctgcccgtgattatggctcctgccggccgctcagtggcccatgggattgtggagcagaaagcagaaaaggaattttggattacgggggggaaatgatgctttaaaaaggcaacagttttctgatgtctatttttttttcattctaagatagtttcataaatttcctcttcatttcaaccaagtacgcttggttacacttcctaaggaattttgttcaactagatggtatgttttggtgaattaatccaagaggacgctactgaaaaaatattatatatatgcagctttcttcacagaacatataacaggatatatatttgggatgttaatttaaaaaacaattttaaggttaaggaatgatatagtgtgctagattaagatgtattgagcaagtcatgctttactttttgttcattttactaggtcatttaaattccttttatgtgctcctcagggcagttaactctttacatgtttgattcagtgctggaaaggctataggtattgaaaggctctaaaaagttaagtgattaaataattatgctcattatctttatcatatttgatgttttaaatactgctaataattcatcttactttatttgcactaaaaagctattcttggatttaatatttctagtaataaaaaaagcaaaacagatattctctcatttgtgttcctcaaagttaattctttattatcttccttctcctcaaacatgaagttttatcaacggtgatgcattttcttgtgtgtttcttactctatcagacttgatccagtcagactcacacacctgagatgaaacccaggctcctggaagctatgaaattgttcagtaatgtagccttataagtaagcaattaaagcaggcctggagtccagtaaggcctatgccattcatactggcaacaggcgatgtattttccatcactctttccccttgcccagatagcttctctcaaaatagatggtatgttttattctatcaagcatttatattaccttttccttcctagccattttaatggaaatgggtggagaataaacagtaactcaataagaagtcataattgctcattgtagtacatcattgattgtgtgattttgtaatataattgttattgggctcttattgactggattctgggtttctcctgtccttgttaggttttgtgttgactattttctctttctatttttttcctaagacttttaaagtgtttctcaaattatggtctttgttaaactttctgcatcccgtaatgtggatgttcaaaagattcctggtccccactccctacccactgccaacagaatcagattctctggaagtgcgagctagaaaaatacattttgaataagtactcctcccctccttaggtgcttcttatgcatgctgaagttataaaaccattgaggaaaatagacccaccagcatcatctgaaacacaattatccttccaattgtgtttttttccccctacactttctccttttttttaatctatcatctcttccattttcaagacgatttgtgagtcaatgtaaatctgtattgctgggccctatccaccaaatctacatccagccttagacattaccaatatcaggaatcatctatggaaagattcaggcttattccatagccataaatcctggaaactgtccttagtcatttagcacagtcttagaggaggcctcggcattctgtggctagtattacaccatcctttagcatcatgaatgtcaaagttgtgctgagatgaagtgaaatgtacctgaaataacaaaaataaacaaaccaaaactacttcctacttgttgagtttctcctacttccaaaattactctgtttccaaaagttccaggtcctacaagtgctctagattctatcctatgcctctttcccatgaggcttttggacatcttcaggctgtagttctttttcctactcccctacccttagaacatagtaagtagttaaatatgttcttgttattatgctcattctcattgtgttatttatacatggcaaacacaacggtgtcttgcacatgtggtctataatctataaattttatttatcattataaataatcttcaaaactatattcaagtaacatcttgggtaacagagcatatcacagataaactgtgaaagcccaacacctatttaactgatttatcaacatgctggtggatacttaaaggatttggagtttactacatattaaagtgtatgttatgttattatcaactcaaactaattaataaaattagccaggtgtggtggctcatacctgcaatcctagcaacttgggaagctgaggcaggaggatcacttgaggccaggagttcaagaccagcctgggcaacatagcaagaccgtgcctgttaaaaagtaaaaaataaaataattagccagatgcggtggcatgcttctgtaatctcagatattcaagaggctgagatatgaggattgcttgagcccagaagtccgaggcagcaataagccaggatcgtgccactgcactccagcctgggcagcagagttagacccagatccttaaaataaactaatagaattttcatcaacctagttcttcctattctggcatgaccagttcagaagtttctgtcctactttagtgtgtaatcatattatttaaaaataccataatttttaaaggtgggtgtttggtaactctgacatttagtggaaaaagatcaaaacaaatccttccttcgattctgggcaactaatgtccacccatcctatgacttttatccagtctggcccatctgcatacttggctagcttttctggtctcagcacgggtaacttctctgttgagaaactttcctcatccagcaaaatctaggtttggggaagctcccacaggctctcacagcattctgcctcctcacaacaccaatgacatttgtcactgcctcctgggcagtctctgaatctaaagtgtttcatattataacttcagtaccaagacaagagcctggaacacaggtggatgccttgatcagtaaattaatgcaacctgtacatgtgaaaccaaaccctgtatactttagcatcatttatggcacagagagccctcttcgctttactctgattaagtggccattcattctccttttgtttggctcctgctcttttgttatggcccccagtttctgcatccattctgcaccatgaatgtatcagttaatttcagtaatcctggtcccatcttctggagctctcaggggactctggttcaggctcaacactctagagattcccagttttcacagctttagaacaatcccctgctccagcctcttaagccaaaccctgagggccccttaagagagaggaccaaacactctatgtccttatgggtgttttcaatctagcattctaacctccttgaaatcataaaaacacattttttttctttgattcattttatctaagtgtcttggacatttccataaatggatctgttgacaataactatgaacatgttttcactgaaactatctcactgatgagtatttggtggctttagaaagagaaatggttgaatattagcatggggtattaaaacctgaaggttaaatggatgaagaggacttgaatgaccttactgaggcaacaccgtgtgaaaaaaaactcttaacattttttaaagtcttctatttggtaggtccacagaaaggcattcatcacccagaactggcctttggaaggacacagacttatatttccatattttcaatcacaggtcaacaaagtttccagactttccaaaggtgaaaaactgtaccttaggcttgttgagtagttagagcagaaggaacaagtttgtcatttgactggtcagtaaacctgtttggtgtctggccagaccaaaaatattttttgaaggggagttctctttgccatgttattcttagttttggcccaaattgtcttttatattttgttggcatcaaggtgggctgccaaggagaagaccccagactctgagcagaccgctaggcagaagcaattggaagaacacaatgagcccttgatctgaaagaactgacagaagaattcagggagtgacaagagctgcttctatccaggagggctagtctgaatgcaacgattaagccatcctggggcacagtgcagggcgcttggtattgattcaatacatttttaaaaaaataagtgaatggggccaggtgtggtggctcacacctgtaatcccagcactttgggaggccgaggcaggtggatcacaaggtcaggaaatcgagatcatcctggccaatatggggaaaccccgtttctattaaaatacaaaaattagccgacatggtggtgggcgcctgtagtcccagctactccagagcctgatgcaggggaatcacttgaacctgggaggcggagtttgcagtgagccgagatcgtgccactgcactgcagcctggtgacagagcaagactccatctaaaagtaaataaataaataaataaataaataaataaataaataaatatgtgaatgaatgagaaattttatttatgttaaatttttgaccagagcatatggctctattactgagccagtcggaaatggctcagaatccagcagtcagcaacatcatactattcagggtcttcaaatacaccctccagtttgaccaacaattccaggaagtgaccagcaaagtctgcctttatccccttccattaagcacgtcaaggccagttttgtgaagcagttgattacaatccccaacctcaagcaaccagtggagaaacctgcagctgaatcccttgacaccactgaatatgaactaaggtgttgggcctggccttgtctgtcttacccttgaaaatgtacccaagagacaatttggttgggactgctgctatttgggagacctgattccaccctgggtagattttttttttagacggagtctccctctgtcgcccaggctggagtgcagtggcacgatcttggctcactgtaagctccgcctcccaggttcacgccattctcctgcctcagcctcccaagtagcttggactacaggtgcccgccaccacgcctggctaattttttgtatttttagtagagacggggttttgccgtgttagccaggatggtctggatctcctgacctcgtgatctgcccgcctcggcctcccaaagtgctgggattgcaggtgtgagccaccgcgcctggccaattttttttaagtgaaattaaaggcccctgacttcaggatgggagtcttctcttcttactgatgggccagcgttctcagtgcactgtctttgtggcaccatggctacagatttgctctgggctctttgtgctaataaaggcgaagggctagaaaagatggaccttgtaacatcttaaaggctctaagagacaattctgcatagggtaagaaaaaggaaattggacagctagacctatggttcttactccattcttaaagtggacttgttccttggataccagggaatacaacattgacatagtatagtccaatggctaaaagtgacctttctgaggagcatgatgcattcaggatacttctgctttgtgttaatgtttcttcccttctaatctattatttccaagctcgcagatcaatgaatagctttactatttaagattccagttgaagggggggaaggcaggaatgtaaatttgtagggaggagggaagagcaatcagccactctaaggtcccatgggagctggcaagcactggaccacagaatggaatgggatgtgctgaatgaagctctgtctgtcttgtacacaccagtcactccaaggagggagccaggaagcaggcggcagggtatgtgggctgtcagagtagattctgctgagaagacatgtgtaagggagaactattgctttaccagaagcgttgacaagaaatagaagctgagatgtcattgcaaaatagaatgcacccagagtagcatttgaatgtgaatgcaatcattggagaacctacggagaggccaggacaaaggagggaatgtgtgaagcttgtttgagagttgcgagtgagaaaaagttgtttgctgcgatgagttgacaaaaggaggatttttaaaaaacaactactactctttccaagggtgaccagtaactatcttagagaggcaaattttatgaaccaggccatgacgggaactgaagaaaatgcctgccaaagtcaaatgtctaaagtaaatatacttttcataaagaaagtacatagtatttgtgcattttataaaatatattttataaagaaaatgtaaagtacataatatgtgcatgtgtgtatttctttaaagacttatttatagaactagcaatcttagacttttttggtcaaactctttggtcatattagactatttaaaatacaaaaagaaataggcatattggtgtatatacaattttctagcattgcttctctaagtattctgtttctctgtcagtctctctctctctctcacacacacatacacaaacacacacacacacacaccatgcacaactattagcagaactgttgttttgcaaaagtttgatggtttttacttcttggaattgggtcctaccagtttgtctattgcccttctgggaaatgtgtccacctgtcatggatgaaaatattgcaaatgtgtcttctgtgttaccgaaagacctaagggggtgaattctattttgtaaccaagaaaagactagagccagttcttaaatgcttcttctagaattcaaataaaaacttagaacatatctactggccatgttgttctaattaaaatatgtcaatattaatgccaactattaccgtgggtacccacacagaagaaagtcaccaaaaaatgtgtgcagtttccatataaaggctgtttttatcactattttaatttaaaatggaatatggagaaatgcatgaaaataaaatgctgtttctaccttcagtatttatacttatcactcttggtactttttctagaaaccctttataggactcttgtgttttcctttccatcactctcctcactcctccagggcacccttttcttctgaaggccaacttgtggaaaccccaggagctagctaccatgttacaggaggctgaccatcatctggactctctcttatgtcagactgtggaatgtaaattttggaagtgccaggagctatagtttctatcatgtatacaaaacttctctgaagtgagaaagactgcaattgacataccaagaagagcacagacaggacacaaaggtatagtcttgtcagtgttcaagctcctggtcccacttatttctctgaattactacccatcctgggatttaattgtcctagagttctttgggttgcatgagccaacaaatgcccacttgtcctaagcaagtattgcttgggttttccatcatttcatcttctattctattcagaagattcagaagatttaacaaagtcctaggtatgaataaggaaataaatcttaggacagattatttccaggagcagtaattagaaatattaagctgtagccagacatgtccatggcatgatgtatagttaggatatgtaccattgaccacaacacaggtatggtggttttaaaaaatatgttgcaaattctttgacactgattctcttttcattaggtcagatctaattccttctccttttgactatggacttgacttagtgacttgtttctaacaaataaaatatgagagaagtgatgttatataacttttgagactaggtcttagatagtttcaactggctttctttctcatggatcacttgttcttggagaagttaacctccaggtcatgcagacaggcaaagaacctggagagaggcctatgtggagagaaaccgaggtcaccttcaacagccaacaccaacttgccagctatgtaagtgagccatcttgaaatggatcccccagtcccagttaaaccttgagatgattggtcaacatcttgaatgcaatcttatgagagaccatgagccagagctacccagccaagccactcttgaattcctaacccacagagataataaaatgtttacatttttaagctactaaatgtacgggaaatttgttgtataataagataactaatactatgtccaagattaagggaaattactttgaagaggttcgtcaattagcatcagtcataagtgacggcaggagatcccaaataggcaactcagtcataaaaataattggagttcatgattacaggtttggtccccaggaaatagagctccaggtagaaaacattgttaatgaagaacacatgggaatagaatcacttaatcatataaaaagagtgatagaataatataatggctaagataaagagtttgagagttaaacagatttagattcggatcttggctccactagtttctgtttgaacttattacttgtctgtattttttagttttattttgggatagttttaggcttactaaaatgttacaaaaattatcaaaagagtacctatgtactcgtcacccagcttccccaaatgcataagaatttcgcataagaaaaaacaaaacaaaacaaacaataacaaaaacataagaggcctggtaccaagtcccacgagtgactgaaatctcaatttgtattcatagaaagtctattcataccaccttatcctgttccctttttcttggtcctactttttccaggacacctgggttgtcctcttctcccttctgtgccaaactgtcctttcccattgaaaattaatgtattcaggctcacttctctctttaaaagatgcagtcaggagctaagaagccagcctgaagtttctcaacctccgtttcttaacactttagcaaaaacatttccaaaatgaatgaccctcctccatcatgccccacaccaagaaaatgtgagaaatggatcataaatttctcagaaaaatgataattcaagaaatttcaaaatataacaaactaccaatatatgtatcatttaaagaaaacattctttttgctctcacatcataaagtaatttgtcttcaaaacttgaatttgagaactattcagggcataaaaatgaagacatcagagtcacatcatatgtatgtgctggttgcctacccgccttcccatcttgaaggtaagcttcttgcaggcagagccagcatcctgagttctctgtcctgtctctaacacagtgcctgtcacacagaaggcatgttgattgactttgatatgatagagaaatttcctcttaagtattccatttttcagaattcattcaaaagtcaaatacccattctttaagacatcttgctaagaaaggaaaaattcattataaagggtcattttgaacattcagaaggaagacctaagtgttgagtaagtgaacagacctttctgctgatgtacttacagagacagaggtccgggccagttccccatcaccccttacccgcaatgttacaggctcttctcagagctttctccatctgggctctttctcggtagcttgttttcacatgtggctgcaagactgaacacagttaatctggtttccctgccttgctgcacagaaggccagtcaacagctctcttttgacttatctttaaacatttttttaaatgttcattattgaggagaaataaaaaggaagcaacagaggcacaaacagagtgaaacgataaggcctaggaaatcttacattgtacttttaatcatggaccacattctttgtttacccaacttgcctttgagaaggagtgtcgcaccctgtgctgggcatctgatcctgcactgctctgtgctctactgggtttatttccacataggttcacatggccttggggcgccatcatggagggtcttgttctcagtggacatggcacaaggcagtatcctcacatagtaaaggttcaatcaatagttgttgagttagtaaatgaatgactcatatggctaattttttaccgatctgatgggtggatgcaatccaacattgccaaagtgaagggttacacagtgggaaggccgtgggggtggatgtatttggcaggcggcagagagaggtacaggacgatcccttacattgtaaatgcaaaacattctcagtggaatttggctttcccacatagtaattatgtgtcatagtgtatacatgctctatagcttatttctcaaaacatatttgtgggtatgtttttgccaatgctattttcataagacatgtctcacagaaatggccaggagcagccagaagcaaaacccaccaagtcctgtttcgttcttgttctttctttgctaatatgtgcaagacttaagataactgaactcatacttttcctacctagaatagaattatcttataaattcttctgttagtctacaagtaatctgccttgatcctatggaattacaagccagtagagctgctgtattttgcttgagtgtggttaccacttggttggcacacactaaggatatttttgactctctctttgctgacatgagctacagagcctggttgagaaaaccctctgaatgaaaacaaacaaaaacctaccagaacaaattagggacaggggaacttggaagccgtgtaagagttgtgaaaccatcagaacattaggatttagggtgtccctttaaagtgttttagactttctgggaatactccctgggaaatgttgtgttttcacaaaaaagttgttctgtgcctgacagcacgaagaagcacgtgaagactggagactgtgagaatgttttcagcaagagccaatctggtagcaaaaggctaaaaattgcattttcacagctccgccagaatatgcaaaaatttcttgtccctatctattttatgacattaaaaatgatttaaggcaattgacacttctatttcttccaaggggaaaaaatagattttgtagagttctggcatatatcagtgcatgattgtttcagatcattgtagctggaatgggctgttgtaccaaagcttatctaatatactttgttcattcattcaaaaaatctttactgaatgcctgttaagtggcagacactgatctcttactgggtatatagaattcaagaggagagccatggtcaacttaatcaagaagcagttctaaatttttatcaagcaaccatagtgaagagacatgataaagtcaacccagttctaaccccaccactaaagattaagaaggaaatattttagtatatgagttaggtaacctggttattagtcatttagggtatgaaataggacttggaaaaggttattaagattttgaagtaatagactgaaacaatcagacttgggaaagaacacagatctcatttttctggattagctgcatttggttgcttgcgaggtgaagctttagaggaaaaggaaaaaggaaaagcattttggcaatcaggttacatgaatagcaggtttcagcagatctaagtagtcccaggcaggctgggccagaatgtccttagataatcaagtgcggctttactggtatggttattatcccaaaggagacctactagaacaggctcaactctgctgctgtacagcatgacctttggtgctttctcttttttatttctcctgtaggaggcaagagctacagcttaatggataagagcccatgctttgtggccagccatgcctgggtttgggtcctgctctgctacttaccagacagccctgtgatttgagtttcacagcctctctaagcctctgattcctgcctcataaaaagggcatggtgatcgtgtgatacttcatagagcgaaatgagcttagactaagcacttagcccagagcctgacacaaggcaaggatctaattctttctagctagtatctcttgcaaggacatcaaggccatttcttgttaatcaaagtgagccagctggcatcacgggttggaaatcccttagcaactggttagcactcagtacaaactcgcttaaaattggtatattggcagttaggaagttaccactaattctgtcacacttaaccatttcataatggtgatctatttagagcagtgattggaaaacaagaactttaaatttggtaaagaagctttatgttgctttatttgtttcagaaaaggacaatacctgagtcatgttctaagaaaaacatgagcatttttgaaagtaccctatgtggactgaatagtgaaaaaggaaaggcacgtggaaaaggacattattattttaaaatgctttgaaatcacattcaaagtcgtcagctaagtttcgtggtgttctggccactgagggactgccaggctctgtcttccttttttgcccatagagaccccagccctgcagtactggtagtgaggctcatggtagctcccactcactggactcattctgtcattttcaaaagatgttcagttcttaaaataaactgacaataaataacagatcaagtatcttatgatctaaaataattcaatggaaatttggaatgaacataaaactatatagatccccatcttccctggctgattctctcagattataaacatattaaacttatccccagcctaaagtagcctgcttgggagttggcagtctctcaagctgcccttgccccctctgctctcctccacagccaagagtacataagaagtagtcctccctgactctatccatttcctccactcccattcactgctcaacctcctgcagttcccgctactcccttaaaattgctctctacccagctagaggagagctggcagctcagaacttaccataggcttaaaggagaaaaacttgatccagccccaggagagctctacactatcctgggctgatatcaaaggaacgcaactttccaaccccatcagtgttcacccactaccaacccctgctctccaaggcaggaagcaggtgagctgagacaagggatgagatggaagcagtcatcataaaggaaaaaaaaaaaaagtgacaactctggaagtcacaaagttaccagtctcaagaggaaatattgattatcttttataaaaattagcgttcattctccaagaacccatttgtatttggaacaatctgaatctcaattatctgagttccttaaagctacaatgatcatattcacttaatttccataaatagatacacttgtttgctttacaatagcacctaggttttcattagagaaatttcgaggaagcacccctctgtctttaattggcttcctaattacactaattttatttgattgatatattaggctctggaggaaagggaaaagaggggaagagaggtcacaatacagtcctttattctcagctccagacagcacaggaaatcctcaattaaactataccacttccctcagcatgccataaaacccatgcattatatttaatatctttaagctcatttataataatggttttatgtgatgtggtgaagttaactcattccttctagactttcttttcattattattgcagaacaaggcatgcttcttgtgaaaaaaaaatcagaagttcagaagaataagtcctgaaaaattaaagtcccccgtccccccgccccgtcctccttaggttttctttagaaaacttccctgtgacaatttccctccatttggagaggcagacaagaggacatctcctcactcacagccaggacactgtgcatctcatatcgtgctgggactttttcttgacaggattgagggagattcaaagttccccaaaaccagagaggaacaaatgcatcaacacagcatctcagaccctggagaaagtccagccgtggccatggttttgctgtagaatgttttcttctaatgcaaagtctgacttagaacaatgtcttccttgtgccttccctttaaggaagggttggctggaccccgacaattagtaacttaggacaaagccttctgagttggtggccccataagggccagaaggaagtggttttcctacaacctctgttcctcagcccggcctgggccacagcacaggtgaaggttattggaggaagagttgtttcatctgggaggcttttccttcccttattatccacacctgagcagcacacaacctagaggctcaggtggatcatagttgtgggatgcctgtttattttgtggtgagcatctgagaagcgtcatccccacctccagagactgctcagctccccatgaaggggtgggccagttctgtctagttcctccactctcttccctgcatggtatctaggagtggcacttccccctgaactaggaatatctgaccctctgtgtctccctgtgaagcccgttgaggtgagtattaatgtctctgatctgaccgagcagcgccgggtttgcaagctcagctcccaaacagctttaagcttgttcccatccaggcagagaaagggagatgttagagaggcttgggaccaaaaatggagaaagaaggcagaggttcagggcaaaactctatccagaagtgctgtttatttagctgagtattttctctctcagaatgatagatgactattggcggggggcgggggagtggtgggcaggatccctgacaaatataccctcttcatatgccgccgaaacattcttggagattgtgctctaggaatccccctgattctgtgattttccacgtttccgtgactgcttgagggtagaattagaacaaatggctaacaggataccattccttacagctcaataatgctgattgtctctggattctgagtaagaaggaaactgggaaacatcagtatctaagtacctctagtgattgggacagaaatttagacgtctggcaaactttctttttctatttcttttttttttttttttttttttgagacggagtctcgatctgtcgcgcaggctggagtgcagtggcgcgatctcggctcactgcaagctccgcctcccgggttcacgccattctcctgcctcagcctcctgaggcaaactttttatttaaccttctcaaagaaaatttaattaattttaatgactttttagcctctgaaaattatttgcttacaaaattagcttaataataatgattacattgataaagatattattttagcactaaatctgaggggagaaaattaccgtgagtttcaaaatatattatttttgactacttcaaaagatgtttgaagtgttaaaattatttttacagtttctcttacacccagaatattgtattgtcttagtccatttgtactgggacaaaatatatagcaaaatacctgagactgggtaatttgtaaagaacagaaataaattttctcatggttctggagtctgggaagtccaaggttaaggcaccagcaggtttgggtgccttgtgagggctgttctctgcttccaagatgacaccttgtggctgcctcctccagagggaagtgacactaaggtagaagagcaagctcctcaaatgctgtgtgaagccttttttatgaaggcacctgatcccgtttaggcagaaaaagtacccctggtctaaccaccacttaaaggtctcacctcttaaaccatcacattggctacacctgaattttggagaggatgcattcaaattgtagccctgatctgtaggaatcagattattgatatcatgtctaagcggcccattgaaaaagtggtagacatttatctttcttgtgctctttcgtagtctaagtgcacgttgtacataatgaatactcaataaataatgaccagacctcttagacctgatttattagtgatttaaacttcataatttgcttttgtgtttagagaagaaagagaggaaaagttatgctgtttggagaaagcagcacttgagcttaaattctagctctaactcaagtgattttggacaggttagtaaactctctgggactgtatctgcttatcaataaaaggcagataatgatcctactatctcatagagttattatgaggactatgatcacacatgaaaacaccagcacaggacatgttcttagtgtgtacaaaatgccattcccttccttgcccctttacatggtacaattgacctgacatctacaggtattaacaagagttctaataaacattgaggcaatatgttctttccctgtaagtgacactagaaggattatatatgtaagtatatattcattcatatgaatatgaatgaattatatataaatatatattatgtaaatatatgaattatataaaaatatatattatgtaaatactatatgaattatatatattatataaataatatatgaattatatacttattcatatgtattgcatatgaataaatagaaacatttcattcatgagtatgaatgatttatatgaataaatatatattcattcatgcatccctcagctcatccactgagctttttacaaacattttccaagtacctatacctgccaaacaataaagtgaagcaatggggcttacaaagaaatataaaacatgatccttccttggaggagcatcttatgaatcctcctcactgtcagccatctgattttctactgtggagacaatggagaagtagaccaaagatttgggggtagggactggtaaaggtaaaaacagaagaagtccacctttgttatattcttgaaagctgattggtatgaaaatgaagatttttgttaaaaagtaatagaacaaaattatcttgtttataatggaacagaaaactgtggcatcaccttctgtctgcaggagttaagcaaagttgttatccttcagtttgaggaatatacactgacattttcactgaagtgaataatgttttgctgtttgtcctagtataattttttgagtgtttctttaaattgttcttgtgtgagttgacagatattttccaggatataattactcgatatcatccaattcataaactcttccttctcaacaaatgttctcatcattgtggtgagtagcatcacgtccttgtacatttcctgggtgtgttaatattgaaggcaggatatgcccaggctggtggcttcttcagttttctttatacatttttgctatcttttgagaaagtctttttgcagctttaaattttggatcaggaacacagtctgtaccttgctcagacatacctggtgctgacctactactgaataaaaaacatttggacttctgtttttgcctaacttggaaagggaaagaggtatttgttagagttgtttcagaatgccaaaggggatagcataaacaagaatattcccccaaattcctttctgctccctctaccacccccgcaatgtgggagggagcttgattctgacagccgtctgcagggaggaatttttagccaatctcacctgcagttatctgtcactgttggtagcatgatttctgaataaggagatggttcctttttaatggaaaaaaattctttatatcccaaacttggcatgtattttagtgagaaaaaggaaaaaaaaagtctgataatgaaggctatagttggtcttaaaccctatttttggccatagcacaatcctaactgatccctaaagactgcagtccccagtaggctgcctttcctttctgagagccagtacagcccttccagaaggtctccactgacttcgtgctgggtgctagtggggctaaggagtagcctttatgccacgctcaggctacggctgcagcagtcccatggcctctgggaagtacttgcctccttgccatttttagttttagtctcttgggtaaccatgctcctgcccctcaatttcttggtatgggggtctttgaacaaggcagtcctatctgatttctcacccagtggtctgagatctcctttcccttcttaggttcagaacaagcgaatagccacaatgaaaacatatcagaaattaacttcagtttgtctcttgctcttggagcaagtgtaggtgttaaaataaaacatgcaaaccaacaaacagataaataatgcattaagtttattttcagtttttaaaaatcatcaatgattctgtattttttttgtcaatgaagacaattttgagagatttcatctgcaaagcagactgcatcctgcattaatttttaccccctactcaggtttctcttcctatcacacaaatatatccccttttactatagtaatgagtgttttctgttcttcttacttaacaataaaagtaacaagccactagagcattcaacagcacaatgtagtaaacagtaacttgctaagttaataaagttccaaccaaaaataaagaacttgacaattttattgctctgtgaagtcttatggtttcaatttagcttttgagaattgtaaaattgctctagaaactgctcccccacccccccgccgcattactgtgggatccctagttagaatttgtcaaaatggatttaggcttttaccttcccatttcctgtagcagcttcagttttcatggtttgatgttcaccgagtagtcagaaagatacaaacacaatgtcctgtgatcttaacgcaagggtgttctattgccatcatgtgtatcaggatttttgtactacatggcctgggacggaaagtacaagagaaaagagggtcaggaagagaaggacctgaaccaaaagaatgagcaaaatttgacttccccctatagattttttcactctaagtgccattcacagaaatttggtatccgtggaaaccaatgcggtacatgctgaagttacattttctctgcagatacaaaaggctagctatctaagctgatgttatgcttagaattagcagagagaaagtgtttgagaaaagtatagaataattaactggatacctatcatgtgcagggaaccatgatttgtacaatgaaggatacaaaatatacaagaaaggatgatagatatgggacaatttatttccatgtaggaatgttgacaacctttagcattctggctttccttaaatttataatgttacctatgaaaatacgagaaaatgttcctgtcacagatttagattatatcctctgctttggtaaaaaacaaaatgttgtcaaacagaagatggaattttcctgagacttattttatagttgaatgataaacaagaaagattcccagaaattgaataagatcataacaaccttgcaggctgttgaccagaaatgaggcaaagctggggacagagggaaacaactaagagaagcgagtgtttgacagcatgttgatttaatcaggggtaaaagagctgccaccgcaataagaaaagagtgtgttcagaggaagaaagtgtgaggaacgatttggaaacaagaacccattcaacgaagttgacgtaggttatgaccaggaacgggaagttcatggcgacttctgtgagtcaggggaggtgcacccctgggcagggtagatattcactgtgctgcaattctgccttaattcaagggtaaaccatagagaagccaactaaaagtaactttgctttctttactatcagtagaattgggtgagagagtgctggcatagccttggggagtgagcctgggtgtctagaaaatggtgaaaaatgaaagaattaaaagcttaacactgttctaattggactcagggaatgatatgtttggatcagttttacgagttaagaaactagatagtttcttacccctgctacatattcactggtcagcacaagtgcaatgtgagtgctcctttactccctagcaaacccggagaaggtggtaaagtcaggattgattggaaatcctgcagcatgggaaatgtggggttggtttgtggcatgacaacaagcaggcatgggagacactgggggaaaaaataggcaacgctagagaaaaatgcatccacgcttccaacctcttgctgaaacgtattcctagttattctttagttctgagaatcaagaacattttcttgttgacgatgtctacctcaataaataaggtgaaagtaccatctgaggcactttaaatgctgcacatgtatgtacgctaaacattagaaatagttttcaagttacaaaattaactttacatgtgattcgtttaacataatttaactcaaacatttcattttaagtgttacaaaacacgtcagttttagccaacatggcagatccgcactatacccaggcatggccccttgcttctctctttaagcatgtgttccaggttgccacaatgtgattgtgagtccgaagagaaaagtcaccccacagctctgtggtctttgccagaaggattgtgtagtgtaagcggtaaaatctcaatcgtttctaggtggaccggataatatttaaagctggtcatcaccctagacatgaagcacaagatgcagacatttgttctatttcttaaatgattggttaaagccatttcagaatgttaagatgagagatctgaggtaaataaactgtctctgctaagtatctgtttctcagggagtgttggtaaataagtatttggtttgctatcactagaagctcctatttttcattttactgtctacacccaactacaccaactctgcgtatattttaattgttcttccaaggtccccaaaagaaatataatgagggaagttcctgctgctagcaaccctctctgagacataatgtcttctagctcttctttaatgctaggtgcagcatctgttttactgccctgcccatcaaaatctttttccttttgcaaaagaaaagcctcatgtcttgatcattcaataaagtgtccattttctttcccttgagttcacataatctgcccggtttaactgctgggttattgggtatgttgttgtaaggacccccttttagtctctttgaattacatgtttgacttatacataacttctccagcaatctcttttcctcatcaattcagtcattagacaactatatattgatggtctattacatgccaggtactgtgctaggtgttgggaacacactgcacagctttttaagtttggtccagtggcctcaaaaagcttactacctaatagtggcctgttactgaattcttgagaagtatttggatggctatgtatgtgctttctgaaaatacaggtaaagtatttccctactcactagaagactcctaaaaaacaatgtgtgagttaaacttctgttaagtggaattcaggttttttttttttgttttttgagacggagtcttgctgtcgcccaggttggagtacagtggtgcgatcttggctcactgcgggctttgcccaccggggttctcgccattctcctgcctcagcctcccaagtagctgggactacaggcacccgccacctcgcccggctaattttttgtgtttttagtagagacagggtttcaccgtgttagccaggatggtctcgatctcctgacctcgtgatctgcctgcctcggcctggaattcaggttttaaatgctgtatacagcttgctattttagagcctcctgcaaagttaataagcaaactctgatttttaatatgaattttaactttagcactgatacattttcttaatgttgatcaatattataagcactcaaaactctcaaacattttaaaatgcataaaacgaaaacctttgtaaatggaatctctatttaaatgcactaagagtaaatgctatttaaaggaatcctgatataatattgtaaggaaagtggttaatcattaacttattttttaaatgtggacttttattgtaatttctatactgtagaaagcaaaacttctagcaatacaaaaaatgtaaccaataagaaaatacaaaatatacttcgttataataaaaagaacacacgagtagtaggctacatgagaccctttacctgttgtgttctgaagaagaaacctttccccagagcgtctgcctcagagtctatgttgtggcatgtattagtttgttggtgcagccataacaaaataccccagatgagtggcttaaataacagaaatttatttcctcacagttctggaggctaggaatccaagattaagatgtcaacaggattgatttcttctgaggcctctctcctgggcttatagacggctgtcttttttttctgtcttcacgtggcctttcttctgtgactgactgtgtcctaatctcttataagtgcaccagtcatatcgggttacagcccacctgcataacctcattttaccttatttaattacatctttaaagaccctatctccaaataaagtaagattctgagacactgggggttaagacttcaacatatgcattttttggttgagggagggacatgatacagcctataacatggcacatctctagattagaaaattccagtttgcgagtaaatagccagaggagtcacaatgcaaactttttttctcctataaaaacttcagcatggattaggttatcagataactgctatgttcagaataggcatttctaaagatttgttgatgatatgatgacagctctcaccttgaagagcagagggtaaaggaatagaaaatgaacccagaaaatgggtggaagatggggttggaaaaatgccagaaggcactgcttcaagaaggcatgctcacagtggctgagtggagggcaggggagggctgcagatagctcctgaagcctgcaggctagcggggagctcagttacacaagatgaagggggtaaccaaagccaggttgtgatttacgaatttgccctgatggagaatatttgatgataagcattaaatagcaaagtttagaagaagtttttttcttcttgttttccaattgttctttctattggacagtttgccatgattctgagctaaattagccctttggagacatggtcgtaagatagtctgttgatctggaaaacagttttcatgaaaaatgagtaggtggtagaaggaaaagagaaataatttgaaatgcaaagcactgtaaatgcatacgagaaaaatgcagtagtagggctgaatagcttttgctcatcaaattttaagccattcattcttaatgtatttggttgttaatgacataagttacgaatcacagtagccaataaatatttgtgaacattatttacattatcattatggaatgactttttggtatggtaaatgagtaacaattctttttttttttttttttttgagacagggtcttactctgtcactcaggctgaagtgcagtggttcaatcacagttcactgcagcctcaactttcctgactcagcttcacaagtacctgggaccacaggcacatgccaccatgctcagctaatttatttttattttttgtggagacagattcttgctatgtcacccagactggtcccaaactcctgggctcaagtgatcctcccgcctcagcaatcccagagtgctgagattacaggtgtgagccaccatacctagcccagttctgttttcaaagggattaaaatgtgctctgactgtatcactatcttattgccaacagggaggagaattcagatggacaatagggttataatgaagtggaaagaagttggtataagatacagcatcagttggcagaaatgacaagttgctagatagacttggatgggtggcacatgccagagggtcaggtctaggactaggtttgagaagagcattgtactgggaggaggggctgagagcatgaatgatgaactgccccagcccccactgaggatgttagagattaagtctgtataatcttttgaaagccttaaaaatcctgaattttgaaactctgtactacccttcagaaatctcacaaagtctgaactctaaaaccctggtcccaaaggttttagataagaggttatagacttggaccagtttccattcccacctgcagtgtacagtagttcccttggccccatattctcatccacattttttatagccagactctctaagttttataaagctaatggagatacattaatgtacaattgtgtatctcattatttttatacaggttcagatttctttccattgatcctttgtctttttactctataatatatttgatcttacaggagactatgattttgatgttagctactttgcacattttctttgtggcctttgcttttgtgtcttttataggaaggtcttttgcttttgatcattggtatatccaatcaaatattttctgacaatttgacagttttggtttttcatgtttaagtctttaattgcaatttatatttgtataatggattttggaatgaatctaagtttaacttggttggatgttatattttgcagatggctagccttgttctaacatcatttactaactagtccatttcttctccactcattaaaatatcaactttatcttttaaagttttatatacatgatgattcacttttagacttttttctgttccattttttacaatttatagatgcctacaccaatattgcaatactttacaatgtacagctatttaattgctgtaaaagacgtcttcttctatttttctctaagcagatttaagattgctgactatattttacatcgttttccttgtatactgtgataccacatccttctttttatcctcatatgttgccacttctcgattttttaataggcttctcctcctttcaatactggtattcccttcaattttcccccagaccctcttctctcctcactctaagcacacttcatgagctaatgtagcttaatttcaccaatatgatgctactcaaaactgttcttctagcccaagtttcttttgttttgttttgctaagtttcatagccacatatccatcttcactttgatgttaggttcaaaagtgaacttatcatctgccatgcctgatatagtttagatatttgttccctccacatcgcatgttgaaatttaatccccaatgttagaggtggggcctagtgggaggtgtttggatcatggcagcagatctcatgaatagttttgtgacgtctttgcagtaataagttcttacactactcgttcttgcaagaactgattgttaaaaagagactgtcagccatgatggcggcacatgcctgcagtctcatctacttggaaagccaaggcaaaaggattgtttgagcccaggatgcaatgagctatgatcacaccactgcactccagcctgggcagcagagtgaggccctgtctaaaaaaaaggaaataaaagaaaatggttttggccaggaacagtggctcacacctgtaattccagcacttcaggagaccaaggcagcaggattgcttgaggccaggagttcaagaccagcctgggcaacatagcaagaccctctctctctaaaaaaaaatatttttttaataagagaatatagacagttgaattgcaaaggaaagaaaatgactaaaaatggtcatttctatgagtgacagatcatgggctatttaagaagaagatttaggatgaaagtgaaaataaaaaagttactccttttagattataactaataaattacagaaagtggggtcatttcaaatgctgtgcttcaaagaatactttgaagtatttattaaataatagtacctctgcagatgagtgagtgttttaaacctagtagtcttagattaatattactgtgtttggtggagataattagatagatactgggaaagacatagacatagacatggacatggacatgcatatcgatacaggtgtaggtatatccttaaagttttctcaagctgcaaatggtgaagtatttgtatcatgggagaacacagtcagcagttgcctctaggaaacagggacactggacactgaatttgttaagacacttcctatgatgagcaacagaaagccaacttaacctcagacaaaaaagaaaatccattgactatcataactgactgtcttagtctgcttgggctgtcataacaaaataccacagactgagtgtcttaaacaacagagatttattttctcacagttctggagaatggaagtccaagaataagatggcagcagggaggtatctggtgagggctcttctcctggtttgcagacagccaccttctgtctgtgtcctcacatggtggaaggagagagacctcttgtgtctcttcctcctcttatgagggcatcagccccatcagattaggaactcacccttttgacctcgtttaagtcagttgtctccttataaacctatctccaaatacattggaggtaaggacttcaacatatgacttagggaggaggcataatttaatccatagcaccaactgtttgaacttgatttctgagagaccattatcttggctgtgcatctgccttcagggcactccttcttgatcttctttgctggatccttctcaatttcccattacctaaacagagtttagccttgggtctattctcatttcctaagtgatctcatgccctcccacagctttcaatactatttcatcgtccttggtgctccagaatgctatataagctgcctacataagattcatatttggatgtatcataaatattgcaaaggtaacatgctatctagcatcacgttagttaatgacaaccaaactcaaataggccctagtactcttggccatcatattatatttctctggtaatttaggctctttactctggtggatgacattttatacctcctttcctcaaacctccatcacctccccgtcccctctcttagacaattgtcatttcactgagaaattagaagtcacagagaatgttcacatacagtgacggttgcactgccattgcaacctgcctaccaacacctgtaccatttactctgttttgccttctatgtctatggatgaaacatccacactcttttccaaagccaataactctgctagttatatatcactgctgaaacaaactaacacaaaatatattagtccctgtttctctaggtgggtttggctaggtactttgcttaaaatctcacaaggcaagaaaacaaggtgtcagcagggctgtattattttctggaggttccagggaagactctgtttccaagttcattcaagttgttggcaaatccagttccttgcagttgtaggacttaggtggctattttcttgctagctgttagttgggggttcactctttgctagtagagatctcttttgcatccttgcacacgggctcacaactcagagacagcagcatcgtgtgaattcttctcaaacttggaacttctatgatgtctgctgcatctctcttctgcttccagccagaaaaatctctctgcttttaagggttcatgtgattagattgggcacactcagaaaacccaggataaaatctccctactttaagattcataacctcaattaaatctgcaaagtcccttttgccatgcaattaacatgtccccacgttccaggaattagagtgtggacttacctggagggcatgtagcctaccacaaatttgatttgtgccccagaaatttgctccctctcttccgcatcaccaattattccccttaactgcattttttccatcagtgtacaacatgctgatattccttttcaatgactgctccatttctctgctctctttggggcaaaacaccttgaaataattgcctatactctttgttcccaattcttctttcgtttttcttaacctttcaactttctactacactcaaccttcttttgttaaagacacaaatgattacacattctaagtttaagggtcaattttcaatcttcatttaagtgtcattttacacagctgatcattgaaatagttaatttaccttctaaggcaccattctctcttggtttttcttatactttctggaggctccttgtcagccttccttgctagtccttctttatattcttgacagcataatcgtggactgcctgcagctcttccatctgcattcattcccttggtaattgtatctagtttcatggctttaagttctacaggtatacaatgacttccaaatttatatctacagcccagaactgtaccctaaactgcatgcttatatattccactgcctagtcaacatctccatgtagatatcttacaggcaaggttaacaaattcaatatcaaacttcatcttccccacaaaacctgcttctcccgccatcccttggtcagtgctagctctgttcttctacttgatggaaccccaaattttggagatgtcattggctcctctcactaatctccctcctttgtacttagcacccaatccatttaacaagtcttattgtccttaacaccaacatataattggaagtaaaccacttctagccacctccaccaaagcatcgtggtagacaccactaggatgtctggcttgtttattgcaatatatcgtttattagactctcttctaccttgacctccacatggtagccagagcgatcctgtcaaaaagtaagtcagattgcctcattcctctccttaaagccctgtttcatgcagacaggaagccaaagtccttacaatgacctagaaaactctccttgatctgtcacctctgcacccattgccatatcctactacttaccagccaaatactccagtccccagagccttgcacttaatgtcctcttgtttaaaatgctctccctatgcctccctcatcaacttcccctttgtgtccaacatcatctttgcagtggcaccttctctgcatactcactttaaaattgcaagcctctatctgactagtgacccttccctctcctgtttcttcttcacaacagtattaccacccgatatcctatataaattttttatttgttgttatggccattctcctttcagaagaatctaagtttcgtggggtcaaagaattacgtgttggagggtgtgtatgtgtgttatatgttttcactgcattctccccagcacctagaacagtgcctggtacagagtacacaatcaaatatctgttgctgttcagtgaaggtccagaactgttatttatttcacctcaaaaccaggctcttctcccagtcttccccatgtcagtaaatggcaactctagtccagtttgcccaagccaggaacctggaaattactcttgattcctctctttttctcacacctctcatcttcaaatactgccaacgctctctgcaaatacacaggcccccttccaaaatctggccctcccaccttctccactgctctcacccaagtccgagccatgatgtgctctcacttaggttagcacagtggcctcatttattggtctctctgcttctactcttgctccctaggagtctatcttccacagagaaaagagagaaatctcttcagaattcgtgtcgaatcatagacattcctcagttcaaaacactctgataggtaggttttcaccttggaataaaatctaagtcgtgtgcatggcctgtaagacatgtcctgatcttgtcccagacataccttctgaaacttatttcttccctttgctcattctcttccagccactctatttcccttcctgttccttggctctgccaagcactcatgtgttgtgggacctttccatggcttcatctgcatggaaggtagaggcacacagtacctgctatgtcccatcattcgggcctccgctccaagttgctttatcagagggctgccctgatcatctttcctaaaatagcacacacaccacacacacacacatgcacgtgtacacacacacctcattctccttaccttattttgaagccctcattgccaactgacattatacgtttacttatttttctttgacaatttccctgcttctccaaaatgtagactccatgggggcaaagaaccatctgttttgttcactattgtagcttcaacaccaaagataaaccccaacaactacagggatgcttaatcctagcgcctaggctcttagggatacataaatactttctttctcaaagaaacaatattagtatttgaaaaaggaatgtggacattctttagtgttgcgcccacccctaaaacatagtctgcctcggagcaatggagaaatctgattggcccctgtgggtcccatgcccccttgtggctctgtcgtgggaatggggctgggggcaaagtccatgcaatccatagaagatagaggaaggaaagttccgcccaccgcccacccaaaaaaggtctgttagcagaatttaggatggggatggggaaaaggaggaggatgtgggggaggcagaaacaacagatggcaactatggggatttttccagagtgggaagtgtaacccagggataagctggggtccctggtaaaggaagtatccctaaataactggaccttcatactctttgggaaagaacaagctgaggccccaggcacacctgcatggcatcaccatagccttgcttcttgaatgactcctgctggcatcaggaggcatctccctggcaggaacaagcctgaggcttcaccacggaagctggaggaaacgcagggacccatggcacaaactgacacaggagttctatgtttcattgcacatcattttgttcaccagtgcatttgtacgattctgcctctatggctatcaagtttaattaacaactcatttttaggtaagagtaaaaatgaattaggtaaaaaaaaataagcaacagctgccaagtgagcatggagcacatacactcacagatggaaaaaatctacatcttgctgctatgatttagctcagggttttatatttaatttttgttttgttttgcttttgtttttatacacctcaccacaaggtattttaaattctttaaatgtattcccgaatatagaaaatgtttcttgggctctcctgagagtggggtgcccaggctgaccacaggcacacacacattcttcccatagtacagtactttaaaattaatagcacatgcagaggaaaaactaaaccctttgacgtcactcttgaaatgaggaaacataaacagaaaaggctccactccagtaagctgccagagttgaagccgattggtctctgcttttccttgcctgtggcaactgacagcacctcccagcctagcaggccggcggctgctcacccagccagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttctttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgaggtatgtacaacaaatttaagcggcaagctcagttttcttgagagaatagagtcacagagagatggcaggatttttatttaaaatgaacctgtacatatatatgttttttgtctgtgattgttactacagcaaccagcttttgaatttccttcctttttctaggcgaactgactaaacattatcacttaccctgaattaaccgtttaagggcagcagggtttcattccaaccagtgtaatgagactccggcattttcactgcactttgagcccacactgaggtggtctttaaaaaaaaaaataaagaatgcaatattttttttctccaacataaatcttggagttgggtaattttcatttttggtgggacaggataggaaaatgctggtaaagggattggtaaggtttgtggaacagggaagaaggaaattagtttttttcttgagtttttcatgttggttgatagcagacttcaagatgaagaaattagtggcaagaagggaagaagctgatagtgagactgaaggtagaaaaaaatcaatagaagatgtccaaaaaatgagctctgaagaaaaatccttcatcaccttgttgcatttttcaaaaaatgttttggattcagaagtccaggagagatgcaagtactaagttacatgaccagaaatttagatattattatttataaaggaaagtaaaacttctttattaccactgcaaatttgctaattatcttttcctacaatagttgaaaatggagtcagatattcaattaggggcttaagtgattgagcctggggactaattaatcatttaaaaattctgttcttcatgtgctctagccagagtgactattgcaataagagtaaacctctttgcaccagagacaggcataggcattcatatacagtaaacacactaaatgctgcaggaagattggcaattcaatacagggctaatgttgttttcagtggcacattattatgtcttaaggaggatccctgctaaaaatcattcctatccaaagagtcggtttttgtaacagcaatttaagtaatatatggttaccatggatttccctattacccttctcaaagttatgcaatagcaaataagacaggattatttgaaatccttaccctgttccaaaatttctaaccgattttcttaaagtttctattctcaacattgagaacctgaaagctttaaaactgggtcatgttagcagtaatattaagcacgatttcaaacatgaggtgtatttcaaagggttaaaaaaattaactgcataagactggaatgtactaagttaagaactgcaaaaatattagctctgaaatgcagaggatgtgccgtgaatggacaattgcttttctgcagcgcctagtgggaaaacaaggactttgtgtgttgcaaacgcataactgcagctcctccatttcctctgctttatcttttattactggctggtgaaacaaagacaggtgtcagtagttacgtcttgattgacattttctccaataaaatgaagtcacttttgtctcaagtagaagcccacagttaactagttgcaactccaaaaactgtctctgccttgtaagaatttttacctgacactgtaagctgtctaatttcagaatgtactcactctcttgaacaacatgtgacaaaatcagtggtgactatatgtcagcaaattagctgggagaatttttttttttaattaagttatttagggcaagggtggaaaagtctaagatgtgtcagggacaggcattaatttagggaaaataattacacgagtgcatcatttaatgccttacacagggttcagcacaaagctactcactgtcagttctccataaaaacctagttaaaatgtttgcctagaatttactacctttcatatattgtaaattatttaaataattttggtcttttcatgtgtttttgaaaagcacttttggtgtcagtccagcctgaaatattatctaaaaatcaagtcaatgatacagagaaggacatttcaaacactgacactttattttcagcctaaggacatcttaaatgcaaaagtaaaatgaccaagtttcctcaaagtgggaatgtaccacctggaaaatgcctcagcctagtaattattcgtctgaagtctaacttgttgttagccaggcccaaatcacaggaggaagctgtttgttgactcacagaagatagtgttggaaggaatttattaagtggtaagctaatcccaaagaatactaaaagggctttgtttatattaaagagaagtgtcaaatttaaggatcagaacagactttgaaacatctaaatgtagaagctaagaggtagtctaagtagttgacctcacattgttggggtacataattgattggaaactctctatctacagaaattcttatctgaataatccactatcttatggattcagctctgtatcccctcaaaaatctacagcttagtaggtatctatgttctagggggtacatttgactgaggaagaaaggacttggcatttggaaatgtgaggtctctctcacagcacaaagaccatctctaatctctattgacacctcctcatggcggcagccccatttcccctaagaatgtactttggggagcacttccactgtccacaggagagtagctgtgggatcagcaccactggcttctaaagacatcctcagtggctctaggaatcccctctttgattcatgagatggtgcctactttatatattagcagtctttaatgtggtttacatgcaaacttgaagaagagaaggagaaaagggatgtagaaacccaaatcaactgaatacctattatgtaccaggcattgttagaaatttcagtacagagagtgaaatatgtcaaagttcttatgtgtggtcaaggcatttatactttctactttctcaagaatcatttaagtatctaaatgagttgatgtgtacttagagagtgatttcatgaagtgcactagaaagggcggtgaacagaggtagtgaaccaaggtggttcattcaggctctaatgagctgggtgactctgagccactcactcattcttgacctcagtttcctcaattgtaagagcaactggttgcgctgggttatctctaacatccattttagatcaaaatttttatagtattcttattctcaacctagaattttttaactccatttacatgtaaatgtagaagtgtcaaacctttattccaaaaatcattactacatgttttcaggatgtcaagggctgtgcctgtgaataagcaatgattcccacattaggaaacgtattctggttgagtatgaatatttaaacaaatgactggagtctgtacaaagaaatgaaaaaacaaaaggagaagtctgagaaggaggcagtgatggaaaactgcagaggaggcagctctatgcaatttggaatttaagaaaaaaataaattgtatttctatttaggtatttatttttatatgatgatctataatgtgattaattaagtgcattgttattattttggaaatcatgtatttgcaatggtgttctcaaaaattagaatgttaaagagagccaaaattttcccataggttgattcagctgctgtacaggcctgatttggtaaatcaaatccgtacattggcgtcctcttcatcattccttgaacttaaaactgtaggagttatggaaagctggagtctttagagagcactatgggcagccaaggtcccagcaggcatctgatacaagccaacaaggttcatagctgtgatggtcttgaacactggcgcaaggtggtgtcaacatggtaggaaattacctcagtgtcaggaaaactctcatggtggctcggaacttcaagattacttgtgggagtgaagacacatttcttcaactctggagcttccatttcttcatctttaaggctgttggatgccctttttctttccaaattctgtgatttaacctgacaaaattaacactgaatcattagcatgtgtttacttttacttttccacctctcccattccttatttccactactctctgtgtagtttgcctttactcagttgtccacatttacacaattttacctccaagataatctcattgccaaggaaaagcaaaacaaaacaaggacttgggtttgagaattcctccccagaaagactatcactcccctgagacagtcacctctcctcgctccatttctcttgtatcaggttgatgtgcccctctgtggctgtgacactcctagagaaagcaaagaggcatgctttgtgaaaattgtagctagaaactttaatattacaagacaaacgtctttttcctaaatgccaatcactgtcctggattttctatattacttcacttaatatcttctcaatattaattctgatttctttagagaataaatgaaaacctgttgataactaagttgagggaaccttcagaagaaagttttggtgaattgattgtccattgagtatctgctctgagaccttgccctgctggtacagggttgctgccccttactagtgatgggatttgatgcagttcaatcaccttaatcgagacatttctgggattctgcgtggctcagagcattccagctggtgtctgctctgagtgagagtttacatttaacacctcaagcatggaaaatagggagctggttttgtagttttggataaacctaaaaacaacgtaacagaaaacacacagacatctattaagcaatatataattcttgatactactgtataaatatcccaacattttaaaagcttaaatcctttcatgaatggtttacatatttatgtgtatacagtatagaagtatgaaaataatagccacagtcaatataccagtaaagaaactttgtcatgcatttgaagttccttcctttctgcccttcctccctcctctcttcctttcttccctccttcccttccttctttccttctgccctcttactccttttcctccctccctccctccctccctccctcccttccttcctcccttccttccttccttttcattctccctcctttcctctctctctttctctttctttcttgaatctgttaaggaaagaagggaaaaatagattggtaatgaggttttgaggagttttccttgtgtaaagtttggagtaatacttacttttttttcctagtggttggtgaattcatatagtttttcattaaatttcctgctgatatttttttcttattaataccttctgtgttctacatagtcataattcacatataaataggaagtatataaaatattctttctacaagatgaaaattattcccattgctttagaagtgctcaaaaaaggattctgttcaaaaatgaagtttatacatgacttaaatatacttaatctctaagaatcttcttttgttctggcgtgggggtggggtccaggactagtatggtgtgaggagtatgtttccataggtccaggcatagacatggagaggctaccatatgcctggattggtcaaaatttgatacctgaaggtaccaaacggtcagtgttttacattctctttgactctagcaaatctttgtctaagaacatatagaattgtttatttttgcattgtttgtaacctaaacaatatcagaaacaacttgagcccaataataggtgaattattgaaaaattattgcaaaatcatacaatagaacaccatacagtcatgtaaaagaatgaagtacctctacatgcaaaaatctggaataatttttcagatgtattaagtggaggggggaagctacattaacagtggtataaatacatagacacattcatatatactttttaaaaatttctggaaatttgaattaaaaacttaacaaacaatgccttggagaacttggagtatgggataggaacaaggcttacttttcttgtatatactttagaattgttcaactttcccctccataaatgcattatatttataaagggaaaaagttactgacatttatttattgtgtgatattttaaagtgaccagaaaaatttgaaggtaaaagaagaaagagttctattttattttatgtttttcattttatttaatttaattactatttttttgtttgtttttgagacagagtcctgctctgttgcccagggtggagtgaagtggcacgatcttgtctcactgcaacctccacctcccagagtcaagcgattctcctgcctcaccctcccaagtagctgagattacaggcatgcaccaccacacctggctaatttttgtatttttagtagagatgggatttcaccatgttggccaggctcgtctcaaactcctgacctcaagtgatccacccgccttggcctcccaaagtgctggtattgcaggtgtaagccaccacgtccagcctgagttctgttttgctttaaaatttcttcattaatttctttctttgacccttactaaatttctcccatgtacctttgacatggctagggagcagagaattccctggaagtaagaatcctggaagccaggagatagggagcccatcattcttatttgagtaactttgggccaatcagccctctgggcaccagctttctcatgtataaaatgaggggcttggtcaagctcaaagttcctttgatctgggtctaagaaactttggcctgttacacgcccaattatttgagatctttctccataaacaataaacatattttaccatacatattttactggtttgaacatcttgactaaattttgttttagaattgatcagttcagtttaatttttcacattaactatacatgcaaaattagtatttattcaaaccgtgtttaaggaaatcacatatcatagacttttaaaggaaaattatactataatatcagttattcataaaacagtagaaaacattatattaagatgtacagcttgtgcagttatgcaagcaagtaatgcttcttctgtttggatatgatttatacatttcttggttttccaggagagaaaaaaaaaaaaaagaccttcatttccctttctcattatgccacttgccagctgggtccagttagatgaaagaactcagtcattcacaaaagtgtagaaagcattcttgtaaaaggagatgctgcagtaatacagaggtctaaagaatgccttgatttagaaaaggtcattaaatctaagaaaaaagttattttctatgtgacagaaatatagtgtgtttccatgttcttaagatgagtgttcatgcttttccaattaaataaaaacctaatttcaattgggtttttagcttcattcggaaaagtgtaggtattgctcattttccatatttagtagtttttattttctgtttttctagatcttcattattgtgtttggagtaaaaaataatctttaagttaaaataatacaaaaggaataaacataaaacaggaatttgtgtgatagcagtttggaatgacaaagactaacattctaaacttttccctataaatctcttttaattattaaaaatcactaagtattagaaatatagttcaatggcttataaataaaataattgagaaatattgttctctttttcattgaatatgttgccccaagtgcccatgtgtgggtgcatgagagaggcccttcttaaacttgacaaaatgcatgtaagagctttgtatgtagtagtaatacaaaaaaaaaatcaaaacattgagttggagaatacagcctatttaaaatatattgtctcctttaatgtaagtctttagaaaccaaataatcaaatacatctattggattaaatggcaataatgagtaataatttaaaattcaatttgcttattttgtgtgaaaggagaaaaggaaaagcaggaaaaaaaaatgaggattccattttttttccaggagcattgaacttgtaacctaaagccccgagttcaagttccagatgctaagaatgatactgttggcaagttatttaacatttttagatttcaggtgtctaaaatgtaaatgtaaacctttaggttccaaaatttctggctttcctatgtaagtagttactcagttcataatacaaatgtcctgtaactttctagaacattcctgttagatcgggatttgttatgcccactttaaaggcaaggaaattgagactcagataaattgcggctaatagttgaaatgcaacttcagctttttgctgacagtttttaattgtttttatatgcttaaaatccatccttaatcattctaagaatgagttaggaaacatttttaaaatacacaaaatataaaaatgtctgttttgaaaatgttaatctacccactatatttttatacaaaagttcaaatatacagaaaaacagtattatttcattttaaatggatttaaattgattaaatggattaatctgatactttaaacttcagaaattttgctctgagaggcagtagagtgcattgatcaacagtgcataatttggcgacattcagtatggttcatttattagctctgtgaccatgaagaagttacttaatctctctaggcctcgctctgcttatttgttagattaaggtgtttctaatatctgcttcttgagagaattcttgagagaatggaatgactttttatttgtaaaatgcttagaacagagtatgaaagagtaaaacttaatgttagtgtatcaactggtattatttgctttcaagttttagaaattatttcatggaattattttgtttacaatgttgttggtgctttaaacatttaagataaatcttgttttaaatttttttttttactttctgaattaaactatagcacacataacagaaaattatctaacatataattatgcaccattgaacccctacatagaagtcaagagagtcaagaaatagaacattattacatgtttggcacctgaggaaacccatcatgcctcttccattctttcatgcagtgttatatctgaagactagataggttgttgcctatcattgtattttgttcattttcattgttgcatgatgtttaattatctgaatacacggtatttaccattctactgtagaaagcattttaattgtatccagtttttaacattatgaataatgctggcctgagtattcacaggcctgtcttttggtgcacatgtacaggtatatctgttgaggttatacctaggaataaagttgctgggccacagggaatgtttatatccaaatttagtaaaaaattcaaaattgctcaaagtggttaaaataatttacgcccccaccaacaatacatgttcagttactctacttcctcactggtaacttatcttggttttaattttcacttccctgtttactaatggtctgagcaccttttcacatgtatattggccatgtaaatatcttttttgtcaagtctctgatcaagttattttgtatatttataggatattatatatacttatatatatataataaacatatttgatacctttgattgttatatatattacaaacattttttccattggtaaaatctcatgttttattcttctcaagattgtttttatcatttttgattctttacattttcataataattttagaattaacttaagattcttccctaaaacaaaatactgttgggatatagatcaatttgggaagactggcatcttttctgagtcttccaattcataaacataatgtatccttctatttatttaggtgtttgttaatttctgtcagtaatatcttctggctagcttttggtcattttacatattccttgctagacatattactgggcacttagtattttgatggtattccaactggcatctcttcaatttctatttttaactttttgttactgatacatagaaaaacaatcaacttctgtatatcaattaattatcagcaaccttgcaaaactcacaaattccaatacattatctatggattattttgcttttccatagaggtaatcagagcatccagaatactggtggtcaccgattttcctttttaatgctgataactttgttttattgtactggataggattttcagtatattgttgaaggggtaatcgtggcaatattatcttgtttccagtctcagaaagaaagctttcaacattctaccactaagtttgatattttctataacatttgaaagtttccttttattcctagtttgctaagcatttcttattaaatgttctttaaaatacttttcgtatgacttttcccttttattctgtttataggtgattgattttataatttcaaaactgaaatcctaggataaatgtaacttggtcatgttatgttatgctcattttcaatatcactcattactctgtttctgaattgctaataatttttaggattttgaaactatgttgatgaaaaccattaacctaaaattatccttttttgttatggccttatcaaggttccattgactttattaaattagttaggaaatattaccctagtaaaaatgttctgggacagttttgtaagtttatattattttttttcctcaaatatttgatagaaattgcacataagtccatctgggtctgaaatattttgtggacaagtttttagttacagttttaattccatttatttttatgggctattcagattttctattttcattgtcagttttagtaatttctcatggatttgttgttgttgttgattatttttcagtgtttcttctttttgaatatatacatttaaagaagcaaatttatttttcacagtttcagctgtctcccctaggttttaaaatttactgtttctattagcagttaattcaagacaatttcaattataatttgtttttcacctgtgaattatttagaagtatatttattaatttgcaaacaaattgggatgtcctagttctctttttgtctttgtttcctagtataattctactgtgcttacaagtcataccattaagatctttgaattttttgaaacttgaatgtataaccgaatatatagtcagcttttctaaacgtattacatgtgcttgaagtaaatgtattctgcaattgttaggtatagtgctctatagatgtcaattagaagatttattcatcatatcattgaaatcttttgtatctttattgattttctttgcttctattactgaaagaggtatatttaaaaacttcctcatgattgagaattattttcctttattttgccatcatttgcttatatattatattgaacaatgtaaaattgccatttttttagatcaaggttgaatatcagcaattttataaaatttaaactagtattttgatactgtgctgttatatgctgccttcacagtaggggcaatacttagttcttggggagccaaaacccttagacatcataatggtttgtgacctaaaaaggttcagcacataaacagatattcagtcaagttggcattaaaatttccttgactggggggagtgtgattagggaaagaaatatctataatggctccataagggaggaggatgataatggaaaaaaggttgagaattccttataaacaattttagaactgttgtaacttcctggcgaattgaaattttaccatagtaaaacatcccttccaatttttttttttttttttgccttcaattctccttgggctgatactaaaatctataaagctagctttccattgcttagtggttgcatgccttatcattttttattcttttagttttaaattgtctatatgtttatgttttaggtgtgtctgtttacaagcagcaaataagtaaattttcttttatcattcagtctgactatatttgccttttcagtgaatatttaatccttttataattaatggaagcagtgatatatttgggttcaaacatgctgacttactatgtacaatttatttattcttcttgttctatatttctttttctctcctcactttcctaattatgaattaagtatctttgtaattgcactgccccctttccgttagctttagcttgttacttttacattattttacattgttttactggtgactattgcggttacaggatgcatctatgacctaatacaagcataatgcatattagtacttttattcctttgtggcaaatttgagaacttcggaatgccttaactacttttgtatccctcctaaattatatgctattgttaggtatttaactttatataatgtaaatctttgaataattatatattattatggtttcttacaattacacatcttcttcattctttcctgcatctctaaggtcacatataggatttcctttagtgcagtgatgattttgtttagattttggttttgtatgaaatggctttattttacctttatttctgatgtgtacttttgctggtaataaaattatagattgtaatccccctcctccttactttaaaatattattgtattgtcttatcacttttattgtttctgttgataagtcagaaaatagtcttttaaaagcaatctgtccatttcctctgtttgtagccctattttcatgtttgattgcttgttttgccatgattacttaggtatggttttctctgcatttatcccaattagggcttgtatggtttcttaaatgtgtgtcgtgatattgtttaacaattttggaaaattttcattaattatctctttcaatattgcttctgccccattatctctagcctttctttttttattattattattatactttaagttctagggtacatgtgcacaatgtgcaggtttgttacgtatgtatacatgtgccatgttggtgtgccgcacccattaactcgtcatttacattaggtatatctcccaatgctatccctcccccctccccccaccccacaacaggccctggtgtgtgatgtccccctcctgcatccaagtgttctcattgttcaattcccacctgtgagtgagaacatgcaatgtttgtttttttgtccttgcagtagacgaacaatgatagactggattaagaaaatgtggcacatatacaccatggaatactatgcagccataaaaaatgatgagttcatgtcctttgtagggacatagatgaagctggaaaccatcattctctagctcttcttaatgggactccagttacatgtatgttcgagttttgaatgttcctactcccattacttaccttcaatctctttgttcttcattttgaagattttctttagaccaatatttttatttccctaagtctttcttcatctgtatctaatctgtcatttatcccataaaacaatttgttaagttatgatattcttcggtcttaaaatttttagggatttttggtcatttctagctttctgtcaaaattctcaatcttgcctctcatatccttaaacatattctgcaaatcattataaaacttttgttgcttttattttgatctcttgagtgtttatagctgttgtctgctgctgctgctggttgaatcaaagtggctggttttcatatacctggttatttttgatgaagcactaggcattgtgtgtgtgtgtgtgtgtgtgtgtgtgtgtgtgtatgtgtggagagagagagagagagacagagacagagaaattacttgaggcctagtgtgatgttatctgtctctagataggatctacatttgcttcagcagttatcagtggtaataacaatcttgtcttaatctgatttcacattgaattaatatatatgaggtgattgaaagtggttggcacttaataagaagtctgcagctattcatttttatctattattgttttcttcaaaagatagggaaagagagtaagggtagtgaggagtagtgaatagtgcatagtgaggaaaacacatatagtattaaaagactccaatatggactagaagtaaatattcaaaaatttttattactttgctgtattttatcttgtatttgaaacaaattgtatcttattttgttttcaatttagcagatttattttaatcattaactttaaaaaacaaaagtagaacacacattagaaaattccaactgttcagaagggcataaaatgaaaagtaaaaatcttcctcttcctctcaccaccaccattcacctcaatctctatctaaaattgtttagaattttttaatatattcataaaaatgcatgttttatttgtacccacatctacatgtactcacctacccttttgtacaattaagaaataaattttaaaatgagaagtatttatcaaaatcataaactaagtaaataataatatgttcaccttccatatttcattgtggccattataatattatgcgaacatttctttacaaaagcattacaatctcatcagagtaataacgttagtttgtaattgttacttgccagtagtactttaacaaagtatcattctgaggttgctaataggctagggagatcttaggtcaaagaactacttgttacagattctgcctttcatcagtagctcacattttccatcaaatatatttggcatactacactattgagctcctgatttatggctttcgtgcatagaagttagtgttttcttgtatagtcgctgatataaattagctaaaattagctcatagcaactttcttcattatctaaattgtttcacagtttacagttctgtacaagctaatgtctcagaatgaaaatgatagtgcatacgtgtcgtaaacacataaaagattatttccaggacactagccatgtcctgtggaaatagcaaataaattatttagatgattgcaaataatataaaccctagagtaagcttagctatgctacggtaaaattctggtctagttatgtaaaactaggtctttggtgttctgtatttatctgttgcctctggcggtttgtcagcttttcttgggtgcttgtgttttcctaatactttatgcaggtttttcctgtgtgggggatctttcgagcacaggtgaacttgaagttacagctaataaatgtaaaatatgctaagtccttagcctagagtccaatcattaataatttatgagcaatttgagcaatttacaagtaacttgaaagtatatgtgtgtagaagagaaatagtaaacagttttaaaactgtgtttgctataactttttcaataggacagattttctttataaaaagatacatatttctagtttttgtaatattatgcagtatttttgttccttttcaaaacagaaattagaaaattaaaatttttgagagagtcaatgttcaacaattttaataatatatgttactaaatgtatgctaaaacattaaattgaaaacatgttaatacatcgtaaggtttaaaaattttttttaacttttaaggtcaggggtacatgtgcaggatgtgcaggtttgttatgtagggaaacgtgtgtcatggggatttgctgtacagattatttcatcacccaagtattaagcctactacccattagttattttcctgatccctctccttcctcccaccctctaccgtccagtaggccccagtgtgcactgttcccctcttaaatggtaagttttatgaaacgttactcttctccgttgataatattataccttacaggtaacagtagaagctaaggaaaagtgacttaatatttaagccgaaggactaagtacattttaatgtgttactccatgaattttcttaactgagaaaatatttttaactttggcatatttttaagtaataacaaagagttatcacaaactggagctgcagaagtagataatagcactaagatacagtttttaattgctactttctgtgaaaaggtgtatgagttgttctctttaatacagcaaacatttacagtgtttcttctttaaagtaatgcaaaaaggtaatctaaggaatccacaaataaatttttcaaagctcattttatgtgttgaattaaaaaaaatttataagtctgataaatttgacatgcatttaggttattcatacaatcttgagtaagcaagatgacatttattttctaactatgaagtgaatcccaaattatgtcatttatctccaaagaggtctcacaacatagcttttttttttttctaattaaattttcaggctaggataagttctttggcactaccaagatgagtttcaaattctacatggcagagggttctctgagtttttgtccttgtcttgggccattgttccacaggtagatgccagcatggccatatcaatcattcacctctggtcgagctaatggttaaatatttttactatcaccatcacccccactccagtgcctgtgttttatcaggatgatggtggaaacatcaattggggagataaacttttttttttttttgagacggagtctcgctctgtcacccagtctggctggggtgcagtggcactatcttggctcactgcaacctccgcctcctgagttcaagtgattctcctgcctcagcctcctaagtagctgagactacaggcaggtgtcaccatgcacaggtaatttttgtatttttagtagagacaggattttgccctgttggccaggctggtcttgaacttctgatctcaggtgatctgcctgcctgggcctcccaaaagtactgagattacaggtgtgagccaccgcgcccagccttggggagtacttgtgtaatgaacacagttctgatggtgcctgtgcactattcattaaaaatgattcttactcctgcttaactgaaattgaattttaggcacaatattttacattgtcttgtttagtatgtccgaaccttaagtacactggctcaattgttttttgactatgacagtctcagataaatcatcacatgattctgtgtttcctactgctgaaggctgtgtacatatgtgtgtgtataaatatacatatattatatcaagccattgaaatgatcatcttttggccaaaaaagtaaatatcagcaatttcatatggcccaatcgtgtgtgtgtatgtatacttgtacacatatgagggcataaaaccagatgactggtatatgatgttagtcttttaattaatagaatctaaaattataagtagtttccttagattttaggattggggtggatagagactgctttcgatggtgtgaaagtatctgtaatttgcacatgtgacaaactattaatcagccccaaattttagtataaatatatacatatatttagtacatatactattactgcatagtatatttatgaagtcttgagaaaaattctgattcctgcttaaatctctcaaataatctcagaaaatctctaatatatggataaaattgtccccatcttgaagaacaaactcagactctcattacttaattagcataaagtcagtacttttaggtgagagagcctagatttattcattcaaccatcaggtatttggggccctagtatggtctagggactggaaataagtagaaaaaacaaagttcccatccccatgaagcttgcattccagtcagagatgactgacagttactacatagactagtagttgtgacagttaatttcagagattgctaaatctacgaagaaagtaagacaaagtaatgagacaacaggttgctggctgtggagacttggctccatagccagaagagagcccaatggagtcttttctctactgaaatgattgagaaagagacagccaaacctggaaaaagagtgatcccggcagaggagagagcaagagcgaagtcctgagaagaaaacatgttttgatgtctgaaagacagaaagggcagtgcttttggagcaaaatgaggtgatgggatggaaggagatgagcaggcatgggaaggtgaggcacagggcatgcagatattcacagggcgtggtggaaattgtactcttctcacagtaaatgagaagccactgaaaccatgtagacagggaggagagaccaagtgattcatgctttaaaaggagcactctgactccagtgtggagaatgggttgtcagcctaggctagggacgacatcataagcagctggtgggtgttgtaggcaagatgggagatgacgatggcccggagtaagctgaaacactagagtggtggacagtgttcagatttgggtatttactataggaatataggaccaaatggtggattggatgaaaagaagaggcagcaatacacaatgctgtgattccagattctggagctgggctccttggtggcatgttctggctctgccccctatcagctttgtaaccttggtcaaatagcctcttctcagtttctgcattggtaaaactggtggagggtgctaatagtgcctaccttagaggattgccataaggattaaatgtgtgtgtgtgtgtgtgcacacaggcttagaactgagttcagtagtaagtactacccctatttatttaggtgatatgtacttgtgaaatgtacatttcacaagtacatatcacctaaataaactaaatttgagaacaattgattatagatttttggcctacatcactaggtggtaccattcactgaattagggaagatcgagggaggatcagtttggaggaggggagatgcaggaaataagagttgtgtttaggacacattcagcttgagaggcctatcagtgaaacagagatgaaaagtctggaattcagaagagagatgaaaactgaatttaaatttatcaatatatatgctatttaaagccttggaactggatgagctcacctaggaagacaatgtaaagaggaagagggtggagaatgaagactcccagaagcgtggggaggttgggaaaggaggaggagcaggaaatgattcaaatgcatccacatctggttttcccatagtgctgcctatattattggagccctgcccgaagagctcatgctacagaagcttctgtagacatgaaagcctctttagacattcttactggtaaggggctgaggcttccagtttggaccctgatgacaggaattttccatttatacttgagagtagcacaaagaagctgtggtaggaatctgctgctctctatttactctgagatgtttttagtgcaatcacagttatatgtggcccctaatgatagatcaattgttttaaattgtgtcattattatatattttactttacatgaagagatgggcatcttcaatttacaaagttgattagaactgaaaaagaatgtttccatggacactgtactattcattatcatttgattcccagtcagcccacaaaagcctgtgtaacccacaaggacgtgaaatcaaagtacaaagaccacatagatcccaaacagcagaagcaacagggcttacagaaatatttgcttagattccttaagataccagaaagacattttcttctcctcttatttgggctcagcaaagcaaggacagagagttgcctattgggtggggtgggaggagctagggaaggcacttctgtggccagttactcacatgggtagtcaatgactgtagaaaacataaatgttgaattgagaaaaagaattctggggaaagacaggaaactggaaatctactcttagctttgacagctacctgtgctatggcctgaaggaagtcactaactgttccgtgcctcagttttctttcattttatattggctacaataatcactttcaatgttgtcgtaaggataggtgtatacacacacacacacacacacacacatataatatacacattcatgtgtgaccatgtggatggtggaaagatctaagtaactattaactattgtttattattattgtcttgtagcctcatatcatctcttggtttttaattttaattaatgattcttaggaaactatgaatggcaggactttaataatgtggagcaataataacagaaatgagatttaaaagaaaacaacaaattcaagcaatgcgggagaaattttattcataacattgtgattaggtcacctagtttctcattagctcttccaatttttcctaacagatgcctcagtgagttgtcaaaaatgatctaattccagcctttttaaaggcttggtgcttgcagcaaagagttcagttgctttagcaagttatcttatgtaaatatggccagtagcatcctggtaatttgcctccagaaagtaatctagaatttcattataaactcttatttattctcacagcatcattcagtgtactaagcagggagaattcctgtttaagattttcataattttatcaatgacttaccaacattgctcaggcttttcttgtagagtatcatccacaatacactaacattgcaattgtctttttaaaaatattttcaatttcacataagacactgcaaaaaaaatcatacagaaaagatatatttgagctttgcagtttgtatagcttctccaaagaatgcagtatgtcaaatgcaagtgttcacagtatattaaaaattggttaggaatcagtgtttcctttctatactgtcagattaatgctctttgcttcaagaccacacagaagaaaacccaacattgtggaccctccctacctaacaaagtctcacaaggtgaactcattctatgtttgaagtgagtctgttggataaagactatcaaggactatgtagacacattaactgaagtctattatggaaattttgtctgaaaatttacttttctgcccacttaatcaactttttgataagttaatatataataaaatgcattcagtatacatgtgaaccttggaaaacataaccttatttaatactactcatttatatagtagtgagtgtgtgtgaatgagtgaatgtgctttatttctcatttctccacatccaaatctttctcttatgttctgtttttgaaaacttcataatcagcagattaaaactatcttgaacttagggatgatttttctcagtttatacttcattctgtaaatagaaacgttctatgtaacgaataatttttgtatacatggacggtccatgtatacgattgctccatactatgaaggttcctgattttgaagctgggtgagtgagctgagagcgaaacaaatctagtgatctgtcattaagtggcaattgttgtttaactcccttcacttttctctaccacaagtttctaaatttctgctgtcaagaacacacctgaatttctaaaccattcacaaacacaaaatgacatgacagacacaaatatctatgaatgggggtaaagatgccttcccaatatcttcaagtgtctgctttgtctccaggttttgcaaactcaatatttgagtccacaaatatgcacaaaatttttttcactgaaataatacggtgtcttgtgagtagttttattttggagtttttggctaaattgtttttgaaggattattgaattatcttttatatagatctttaatatagtatgatgtagttctggtagttttatgaattctggaaaataatgggtgcttggagacaatagtagaatttactgaatatatgaggtaggcatatatgattgattttggagggcattgtttttatcttcattgtgattgcaatagcaacataaacatgttgtaagtagataggcaaataagaaaatgtaaatattgataatttttaacttataatcaatataaactttggtttatattcacagacatagacaatgtttttatattaaaaagtttaaaattttaattgcaaatatttcaaatataagaaaactatcagaaataatatgacagacatccatgtatccaccacacagatggccatctattcattaattcatttattcattcaacaaatatttattgggaactactaagctagatgttgttctaggcacctgcagattcagcagtaagcaaaatagatcataataaattcaatccatatgtaaaagatggtggttgctgatgattgctatagaaaaaagaagagcagagaaaatgctagggaatgtgggaggatgggcatgaaatttttaagaaggtgcttgggaggtctcactaagcagataacttctgagacttgaaggaattgagggagtaaaccatgcagatacctggggaaagaatgttcacagcagaggacacagcaagtgcaaatgcctggaggtgggaatgcatctgatgtcgtgagtctctctgttatctctctgtctgcttcattaatttctatccttggtctaatggttttctttcttctactgatttgtggcttactctgttgctgagttttcttcttactttctttctaatttatgccttgcaaactataaatttccctccaaatgcctttttagctgaacatcacaacctttgaaagagggtatattcactgtggtccatttctaaatattttataatgtctacaattttatttctactcagtaattatttgaagtggttactttagatttcttaagtgtgacaagtggaaaggagattgcggtcttttattattgatttccaaatttaatgcattgtattaagggaatgctgcttatgtaaaatgattcctagatatctttgaggtttgctttgtagcttgtcactaatttttattttaaaaaatccatgtagaaatgaacatattttctgtaattgttggaaacagtgattatatgtagtcatcagagcaaacttgttaactgtgttgtcaaaattgtccatttgcttacactgggaatagtctattcccttacttatttgccttctgggtcaatgactgtaataggtaaattaaaatttcctgctatgtttatagatttgtaaatttctccttgtaattctgtcaatttttgctttgtatactttgaagtttgcctggtagataaatgtaaattcagagggataatcttcctggtaattgttacttttatttctgctaagaagtctattccatttattaaaatattaataatattctaatattaaaagcttctattccagttctcttttggttacagttttcctgatagatcttttttatcctcttactttcaacatttctgtgagtgcatattcttggtgtgtctttttaaaacaatatataactgaatttagtttttaatgcaatcactttcttttaactgtcaagctaaatccatatatgtattaagaattatttatttattcacatctaactttgttttgctattcatcctttttttgttacttctttgcttttttctgctttcaactagatggattgaggttttaaatatattttctcttattggtttagagattagacatttcattttttgtggtttcagcagatacactcacatttttagcattttatactagaataaaaatataaataaatttatgtgtatttaatatccctatcataccctagaaaaatataagaaacttactgaaatcatcttaaatgagatcatgtccatccctagaactgttattgttatatatatctgagctctactttgttttgaaaccctgaactattatctttttaaatttttatagcaaatgcttatctaaatttcctcatgtgtttcccaatattgctcaacattccttcatgaattcatttttacttttcaggttcacattcaatcttgaagggtatgtaagtggtaaatattttcagtgtttagactaaaacgtatccttatttaacctttgttcttgaatgataatttaacaggatctagaattctctaggttttcgttattttttctgagcactttgaggacaatattcacttgccatttggtctctattgttgccaacaaaaattcttttgtgaggctaattggtgtgactttgtggtcatctgttatttctggttgcttttaaggttttctctctgtggtggttcaggtcttctgcaaaggacacaccaagacaaaattagaaacaagagatttggggaggaaagtggctgtgaaggacagagcagaacgggaaaggaatagatagagacagccttcagacctcagggcaggtgtgacccgataaaaggggagggagaagaaaggaatatggggtaggaaaaggctcaagtagcagtgcagccaggctcctggggacctgctaagtagaaatggctgtgagaagagtttggcattagcaggaaggcctcagctgtagtaccccaccatgcctagcacagaagtggagcagtctggggagagagtggcctccgcacacacctgtggatctgaggctgtcggctgtcagctaactgcacgcctggtagcagctcccctttaagaggagagctgagggccaccacacttgtctttcatgttctacagcttcactaaagtgtctagatttacttttatttttcctaccttataatcttgcatttcttctcctacatttcatatatttcatcataagctggtgaaatttcagccatgctttcttggaaaatggcatctcctaccttttctcactttcttgaacttatatagtcgatagatatgttcaatatcctcattccaggctgggcgtggtggctgaagcctgtaatcccagcactttgggaggctgaggcaggtgaatcacgaggtcaggagttcaagaccagcctggccaacatggtgagacccccgtctctactaaaaatacaaaaaattagctggtcatggtggtgggcacctgtaatcccacctactcaggaggctgaggcaggagaattgcttgaacctgggaggcggaggttgcagtgagctgagattgcgccactgcgctccagcctgggtgacagtgagagactctgtgtcaaaaaaaaaaaaaattcccatccatcattatttctaaaccaccctttcatatttgccatatatttatttcactatacttcattgtgaaaatgtccttagatttctcttccagttcagtattttattgaactgggtctaaaatacttttgcttcatatttgcgttttcatctttaattaccatatatctcatttctagaagatacatttgttctttaaaaaaaaatctaccgaattctatttcagtgtccattctttctctataattttgatcttttcctttatctccagtaatctgcaacctgcttgttttgtggattccttgacattgttccattaacttgtgttctgaaacttctgtctgctgactccttcttgatggatttcctttcttttttattttttatttttattatttacttctttttcatgtcatgttttgggattgcttccaaatagtttcccagaaattttgccattctagaaccagtttacacattcctttttttttttttttttcaccttagatatcctgtaccattcagatgtcagtttcagatttgggctttcaattttttatgtgggttgctatttgtttcctttttcccatcctgggatgacagaaagaaattggcttgtcacttccctggaatgatgaccttttatttctcctttccctgaggggcagcccagggtcatgctaatgcaaagctctaggttccagttccttcactttggcttctaattggacaataaaaccctaaccctataccagaggtctcagaagtcattaatatctttcttagatttggttcgctcagaagcagatcctgagactcaagggcattccatattctttgggaagtacacagacctccaggaaaacaaaacaaaacaaaaaaaaaaaaaaagggaggggcagggagacaaaggaaatcaatagactgtttttaagccagcaacgtcagtggatgattaaagtgggaaacgggaaagagtgtaaaacacgtgcttcagaattaagccacccagagggctgaaggagctcgtatatttatacaccctatctggggagtcattggttgagggttactagagcagaagcaggagatagtctttgacatctccaacgtgccacatgcaattagagcaggtttccagagttctggggaaaggaagccctaatttatagagaaggaaatcctggcagttccaagtcaaagggaataccctaaaaggcccaaggggtatggacagagaactttcatcatctgccgcaatatcctgttagttgccacgtttctctcatgaccataacactgaatttaagttacttctttgctatggttcttagaaattttattttctttgatatttgtttaataaatcatttacatttttattacatattttatcagtctttttttttaaaatagtgtgtttatagtgggaaagaggtctgcttacgtcagtgctcatgttgttagaaccaaactttcaaaatattttaatgtacactttaactttataaaataatactaaatatgccatcacaacttgccttaatattcaaaataactttgacaacttttccataaccataaatgtaggtccactttactttgtaaaatgtatttctccaaattaatatagatatttgtctacagatgtcgctattacaaagaatgcaataaacattattttacctattctttcatacgtatgcttgtatatctttggtataaattcctagtactagatggcagggatcaaaacttttagcacatttaaactttaactgatatttgtgaaatctgcctaaattgcttttagcattctttattctcacccacagcttgggagggtatcttcttttctatccttaccaaaaatctataaacatcagtcatttgattctttgatgatgtgatgagtcaatagtgatagatcacttaatttgttttatcttaattattagagaaggcaaaacattttatatattcctgacaattgatattcacatgtacgtatttttatgggcctgccccctttttttatttgatttgtaacagctttatattatgaacactagccctttgtcatatatcttgagtatattttttgaagtttatatttcattttttgaatttgtttattgtgactttttacccatgtaaaattttatgaaaccaatttcatccatttttgacttcatggtttctcatttttcaaatcacacatttaaaaagccttctataattattaattataaaaagattttatgcagttattggacgcctcccatgaattggatataccatggcatgaggggaaagggacagagatgaataagaagccttttattgcttcaaagagtatcatattaaatataaaatatttttttctctagaaggaatgaagtaaatagaccttttcccctctacaaacaaacaagggaacagataacaagtctctaaacttgtgtatcttttttaaaagaaaaactccaaccagtcaaaacatcaacaaatatagtaaataataatattcagaactgatcagcgagaaagccaggcctagaactcaaggtctgtttatatactgatactgtaagactggcaaaaacagtgccacttcattagccaaggcatactctgcaggacctacaaaaagtggttttttttttcttaagagtacttttaaaaatatttaaccaatactcgtctcagtagcatttgtagacaactgtaatgaccataatttgctaaatgttgatgcaagaaaaatactttttaaagacataatccctgtccttaaggaaatacagttggagaggcaaactatatatgaatgaaacagcctaagaatgatatgaagaccagacaaaacaatgtgggatagatcttgtgcttatggtcagagcttaggaaaagggtcctcagtgcccctgtggcaatcaacaagtattcatactaactccatgtagaacttcctcaagttgtaatcttatagattgtattgatgcttgctgatacaaagaactcttagacattgggaatgatataaatctaaataaaattatgtatgtacataattatgcaaaactataaatatctacccccaaattaaataaggacaacccccaagtcttgatgttttaaatgttaatgtagtagagcagaaaagtgagcaagccatgaaggcagatgctctggaaaaatcactcttgttttcatacgcatcgtaaaacatcaccccacaaaccacatcctgacattgctgacattcacccctcctatacatgctcagcctgagcctgtttggcttgagttgcctgacagtaaaacaggattcagagggaagatgaaagggagaaagcagtggactacagataatccactaaacagaaaatcaactcagggaagtctccgcttggggccatgtactttgggaacaggaatgttggtgtataacttgaggtctcatgagtttattcatccaacaaacacttatgaaataccgactacaagccaaacatcatatgtttagatgggtggagtcaagaggcactttttaagcagttagggaaggaaaatctcaggcaagggtacggtaagttgtatgtgtagaactaaggaaaacatcacagacatagtctgatggctgggaggaggcctcagattggcagtagaaaaactgaaagtaaaacaggattgaaagcaacgcttgaaagcaacaccatgaatataaagaagtaaatttgtcttcattcccctgtcctgggacttaagaaaaagagaatttggagctgatcttccactgggccctgaagttgagagaggcagaggaagttaaagccaagattgctatgcaaaagaaatctttcagcaaaggggatttcaaagtactgacctgaataatttccatttggggctgctgaagagaagcagttgtgttcacggggtgaagcaaggaggaaatgggaagttgtctggatgctttctttgcaatcaagataatactagagctcagtaagtgaggaaagaaaattataagtttgctaatagttctaatcccagagatgctgaagagaaaactctttttcttttctaggcaagagtcatctcagggtaaatctcagaccaggtatgaagttcgcacatttctctcagtcagtgtatttcagagcctgggaaatacagagaccccatggggagggtaggcaccatttgcttttattgcatttaagttttttggaacatgcaagtgccctatgctgttgtatgaggctacatgggagcatatctttgagactcagaaactgttggaatcacaatgatgtataaagaaacagtaaggggccaggcacggtggctcacagctgtaatcccatcactttgggaggctgaagtgggcggatcacaaggtcaagagatcgagaccatcctggccaacatggcaaaatcccgtctctactaaaaatacaaaaaaaaaaaaaaaaaatagctgggtgtggtggtgcatgcctgtagtcccagctactcaggaggctgaggcaggagaatcacttgaacctgggaggcagacgttgcaatgagctgagatcgtgccactgcactccagcctggtgacagagcaagactctgtctcaaaaaaaaagaaatagtaaggtcagtgttggagtctgcatgctaataggcaggtcccgcaatatattttttaataacaaacacctactgcaatgacctgttaatgtagagcagctgtaagcctgaagacttaagggaatagaagctaataaacccaggccaaagtgtactgtagataaggcaacttgtacagacatcagaattgaatccatttgaagtcactaacatctctctagattatttcctctctttctctacattacatgggattttattttagaagaactcaaaatactctagaagaaggcagttgaggttactgcattgtataactgaaataactgtacaattatatttgttacacattatttaaaaaaaaacagacttgaaaatgtgttggaaacaaacttgagaaatacctgtctacctcaacctcttccatcttcccacatgcgtgtttaatttgtagactgggttgaggtgtagtctttatttagtagaggtgaaattcttttgccatatttttcataatatgttttggcaccattcttcaatttagatttaaatttgcaagaagttattaggcttgggatgagaaggaaggctggcaggagcagctggcctgatttatctaagggaattactcaaagcctgttaggtataaaatttgtggtgaattttcctattggatatccacagcccaccaaattctcatttattaccatgtggtgtgacccccgctgagaacaaagacttcgattaaattattttctgtttccctgagttactgacagcgctaaaatatactatgaacctcatgtaaaaaaataaaaaagtcttcaactaagtaaaaattatttccaactttctctccctctgtgtttttcctgcttcctggctctcccctttgttgtttcccttcaatatcaaatcatattccacactgtttttctcagtttgaacattctcactttctccctttccattcatcaatctttctgccaccttccccttaagtatttcctcaatttaaaccttattcaataaatacatacacttcacagactgaacagatggattacaggactttttcccttgagatttccatgtatagcaattttcacttctcaaagaaaataaaggtgatgatgatagtgtctatgcagttttttaaagtaatttttgtgctgtgtgagctctgcaacttcagaaggcaggctccttaccacacttgacttgtaatttctattttgttaactatatctgttatgctgagaataacagattgtcttcccctatttgaacactttcaatgaccagtggagacctgaatatttcactagatggccggtagttttatggttcccattattataaagttttctattacaaagagctgaaatccatttctgtttttcaccattggtacaaaagagaacaaatataatctcttttttcataaggtagacattgaaacatcaaaacacaaatctcctctttttcagactacatatcctcaattactccaggcattcttcaggtatcagggtgtccaggtgccttgagttcatggtttctttttactaatacactccatttggtcaagttttctctttaaatcttgtcactgatcttgaggaatggcttagtcatacacaatttatgtccaccactaaagtactaatgtgtattctatatatggaaaatccccctaaagcctgttaaacatgcggctcaattggacatacactaggtgtcctaacagctctgtttaacaaggtgacactgagccctcatgagaaggccttcaagcctgcccagctcacatttgcttatgttttctgctgcttaaataataacaattcagcaaagttaagtgaggactgtctctcaatgtctaatatttattaacgagctatgttaattctcctaggccatcaagtcctaggaaaagaaagtaaatttctatgaaaagtaatttctaagtgtgtctgcaaaatccgatgatgtttattgcttaaaatatgagtctgcaatagacggtgctttagtcaacaagacaattacagtaaataaatgttgtcaatgagatcaacaagaaacctgctttattcaaagaactttcatcaagtgctcacatgtggctggcactgaactaggctgtgtcctctgtctttggtctacactctttgggctttcaatttgggtcaaaataaagagagacctcatatttccaggtcactgaatgtcctgcactgacatctaaagcatttgtttcagggcctcccttaccatgccgaagctctttcctgctggggtgcctcactctgatgtactcagatcaccagtgaaaggagctggcttctattaattatcaggttctgcccagccttgctgggttaaatggacatgactaaatttgcatggttgatttccccatcggcaaagtcatctgggtttcagctttgttttgcgtttggtaggaaggactcatttaatacactgaatatgactatattttataaatgtttcatgtaaaataatctctgaagcttagtatgtataaataaattcctgccatttgaattatagcagctcatatcccacacatctgcagagtttgcttgccagtactgtccatgtgggataaataaatatcgctatatatttaatgggtctatgttagcttcatattttgcttaaataatgggtgaaattaaatattccaaattcatttttttaaaagtagattctactagtaaccacttagtgtgtattgacttgtcagaattttcagaatttaaagcatgctccagtggcgcaatcagctagtgtgcagtacttggtatcacaatgtgcaaggtatgtaggttctttcttctagtcatcacatatgatcattacaattctattttgtgctcttttcaaccagtctttccggcagaattttcagaattttcctgattcgatatcacagaagtcctttctatggctttttgacttcatgtccttgaaatctctatcctggtcccagtactttcttaaggtcactagcatcctgtacaccaaatcccataacacttgctggtcttattctctattgactatggcatttaatagcattgacagtcagtagtatttatagaactctcttctcttgttcttggggacacctatatttctaattttattgattagtcaatagatatttattgaacactgggattgtatcatgtgtatctttcttcttgtctccttccactgctcttttcgtgatccctgaactcaaatccagtctttgtctttcactgtttttctcgaagctgtctgcctatgagtcaaattagtaaaattacaggaattttgagttagaagggactatagtgaccagttaacttagttagcattctacagatgaggatattacacccattaaattaaacgtctgctctaagatctcacagcatgtcagcggcagagcccacatcaactcatggaaaagccagggggatttccatgccgtcacttaacttgtgtagaacctgattcagggtcttctgaagccctgatccaaccctccactctcctggttttctagttctgccatcatatttctattcttctctatttcagagtctagattttagtaatatttgatatctctcaatttctcacttccccctactcttagagccaaatattcatgatgtttcataaagcctgttatcatgatgcctcataaagcctgtcatcatgatgccttgaaaatgtggggagggttttgttgtttgtttgtttgttttttgttgttgcttgtttgttgtttttttttttttttatctcactgccactaccgtggcccagggctgcatctgcataatggtgtgcacctttccagtgatctctcgggcatcatcagtccattctacactcaaatgtttgaaataccactcttcccacatcaacatgtcagaaaaccagtgctgatctccatttataaacagttctctttaaatctttgtaaatgttcagaaaaataagagagtcctttggagaagcaatgtctattgcaaatgaaaaatacacacattctgctattaagtgtaaccccattccaagaaattaagctttgaagaagaggaaaacaaacaaacaagcaaaagtaaagaggttactgaaagaaaagaactagctagctgctggaaagactggttgaaaagagcacaaaatagaattgtaatgatcatatgtgatgactagaagaaagaacctacataccttgcacattgtgatagcaagcaatgctgagaaaacatgtgagatggaaaagcaaagctgagtccaatcagttgtttctcataactgttaagacaagatgctctggcggactcctgttaattcacaggcatgcaggcacattttgatcatgtgtaaaaacttagtctataatagaggatccttactgctgtggagatttctgtcagctttgagcaaaacgtacaacttgactcaatttagtttgctgctagtttcttgcctaacctaatatcaacccccgtcacattttctgaaacatacaatggccttgcttcaatcaggacagtaaacagcagtagtcaaatggcagctgactgaagagtgaaaaatactaagataccgttgagtgcttttaaggacaccataaggtgtccttatattgtagttgtaatgaaacttttcctgagtgtagggttgtgaatcaatagcacctttatcatgcaggtgtgcaagaagccaaggacctctgcaggatgataacaacatgttacagcaatatttccttccctttatcatctttttcctaccttttttcccttaaggaatatttgcaaatttttttatttcagtagttttttgggtataagtggtttttggttacatggataagttctttagtagtgatttctaagattttagtgcacctgtcacctgagcagcatacactgtactcaatatatagtcttttatccctcactcccctctcaacctaccctgagtccccaaagttcaaacatcacacttatgtctttgtgtcctcatagcttagctcgcacttataagtgagattatatgatatttgcttttccattcctgagctacttcacttagaatagtggcctccagttccatccaagttgctgcagaagacattatttcatcctttatggcctagtagtattccatagtgtatatatactacattttctttatccactcattggttgatgggtacttaggttggttccatatgtttgcaattgcaaattgtgctgctgtaaacatgctcgtgcatgtgtcttttttgtataatgacttcttttcctttgggtagatacccagtagtgggatcgttggattgaatggtagttctactttgagttctttaaggatcctccctattgttttccatagtggttgtactaatttacattcccaccagcagtataaaagtgttcccttttcaccacatcacaccaacatctgttgttttttgtctttttaataatagtcttcttgcaggagtaaggtggtatctcattgtggttttcatttgcatttccctgatgatcagtgatgatgagcattttttcatatgtttgttggctgttcgtaaatctgttgagaaatgcctattcatgtcctttgcccactttttgatgggattatttgtttttcttcttgctgatttgtttgagttcctgtggcttctggatactagtcctttgttgaatccatagttaatatttgcaaagatttgctgagcatttatactgtgcaagaccttttgttagaggctggagatataacaatgagtcttgctttcagtactttataattgctctgcagattaactgtacagacttaaaataattttccctaacctgtaaccctaccagaaaaataattaagagaatatgaaaggatctgcttaaatcagaaaagtgaacgtatcagttagactaagtaatgatggtgaacccaatattgacaaagatactaaatatacacttaagtttgatatttatttaaatgttgtgtactgtattctgctttcaaaattattaagcaaagatttgtccttagtagttacccagtatttacagagaatatattaattaggggctttattttattgaaaaggcttaattggctatgcaaatctacaccctctcaattatctacatttggagcaagtttacttagttggtctaaataagcataatttgtggcagttaccttggtgttgtcaaatctaaacctttaaacaaaaaataaatctcatgtgaccttttctgaatgaattctcattgtttctagcagccacctcaatctttcagcccaatgtttagattcccctgtaatccaatcatgatttaccttttgacagtttactccctactactccccaattctttgttctactgcgcttactatttccctggacatatatttgtgattatttacatcatctttcatcttgctatgtcatctcttaattctctccaactatagtactattggcatttaacaaattcttactacctgtgaactactgcattgagtgcttttgcctatattatcccacgtaattgctatgatacctctatgacctcagtgagtttcgttttaaagacttttataaactgaggcttacagacactgagtaacctctttacaagaagaggactacttagtaaaaaagaggactaagtaacctgctcaaggtcacacaattagtgtgaccttcagttagttattgaacccagatctaacggcaaatctaggtacctaaccattatgttctgctgcttccaaggacttagagctatgctactggataattatctttgggacctcagataaagtaactgacatttctgagctccaataaagctgaaatacacacgtgtgtgtgtgtgtgcatgtataacaccttaaataggtgtgcatgtataacaccttagaataggttcttgttattttatttatacttattataggtataaaatataggtataaaataaacatcactgttctggactatttagaaatatagatccaagaagaacaactaatgtcgacagtaggtgtactagtttaaaaaataaatattataaaaaataagtagtataaaaaataaatattataggtataaaataaacatcactgttctggactatttagaaatatagatccaagaagaacaactaatgtcaacagtaggtgtagtagttttggttttctgtgtttataaatattttttctaattatataattctggtgtccagaagataaatgtgattaatataatctaccacaagcacatgcccttaaggaaaacaagcagaaataaaacaataagaaatactataaatacatctaaagttgtgtgatttctataagttacaagtgaattttactaaatatctagtctagatgattttcccagtgattcatccctaacttcagttttgagcagaaattcagttctaaagtttgcctaataatataaatggaatcttttactcagcaggttgatcttccaggggtcatgcccagttaatagattcttgaggacatctttaaattctcttaaattctaaaggaatcctgaggtttgaatacaatgacccaccaacagataccccaggcctatgttagagtataggtctaatgtgactcaggctctcactgaaccaccttcaacctgacctgggaagaccctggctctctagatccaccatgtccagctgtctccagctgaacaatttttttttttttgacagagtcttactccgtcacccaggcttctgacctcaagtgatccgcctgccttggcctcccaaagtgctgggattacaggtgtgagccaccgcacccgaatggtgctaccaattttttttttttttttttttttgagatggagtctcactctgtcatccaggagtgcaatgacgcaatctcggctcactgtaacctccacctcctgggttcaagtgattctcctgcctcagcctcctgagtagttgggattacaggcgcccaccaccaggcccagctaatttttgtatttttagtagagacggggttttgccttgttggtcaggctggtctcgaactcctgacctcaggttatccgcccacctcagcctcccaaagtgctgggattacaaacgtgagccaccgcacccagacggtgctaccatttttttttttttttttttttttgagatggagtctcactctgtcacccgggagtgcaaatgacgcgatctcagctcactgcaacctctgcctcctgggttcaagcgattctcctgcctcagactcctgagtagttgggattacaggcacccaccaccacgcccagctaatttttgtatttttagtagagacggggtttcaccatgttgatcaggctggtctcgaactcctgacctcaggttatccgcccacctcagcctcccaaagtactgggattacaggcatgagccaccacacccagatggtgctactttttatatcagtctcagtgtgtgaattgggcagggacatgagtgtaccaattgtttgatgtatataattattttctacttcgtatgatacatgattcacaataatttacaaactgataaaacaataacattttaaaaaatgaatttccattattagagatttctgaagaaacataatgttgggatatggtggacaagcgaagaatttccttacaaaattattctttactctctgattgttttaacaccgtaagtttatcagacaggttctagatatttcctatggtacttagagccacatgcagattgtttgtgcgttcaaactggtcaaagttgcggaccagagtgctgctattgatttgtttcactccggtgaatgtaaatcattcatgtttggcagcatttgtcctactggagataaaacataaggaatatgtgcacagcttcaaaggtgcagcttgactgtgatggtaacccagcacgcagtgggtatgactggcatttttgagaatacatcataaactctccaaggagtctgcaccatcttccctgagatcattatatatccaccaaaatgaggagaaggagaagaatgtggcaagagatcaaaagaggcagtcactataaactcacctattttgttgatgcaaggcaagttgcactaagtttaggaaagcaaaaagatactcttcgaggtccggggaggaaatgcagaaactgctaatgggaaaacgagcatggtccatataggactctgatattagagttgttttttttctaccgaggctgctctacccatgagtatccccatcttcaagaaactactaaaagttgaagtgtttattcacgtgttattttcgaacagttaactgtataaaagaaaggcatattttcttttcctgcatccataagccatgtgccaaaaaagctcttgtttaacatgcttcttaggattaaaagggtttctgctgcaaacaggtctgaattacatacgcatcttaaacatgcctcagctttaaagggacacattcttcaagtgaggctgcatttacaggcgcaatagatttttccctcggcataagccaaagagcagagacatactttaatatttctgacaagatctgaactataatattgttctgtttggaaaattaggcttcaaagcagaagccatacatttattttcaagatgagaacccaaagagtaacaaaaatgattagaaaaagaatctgaaagagtgagactcattaaaatgaaaatctttgtgttgatgactgcatataaaatcatagatcattagggctaaaggaagaatgtatttgccagatgttgaaatggcaagatagtttcatctctccctaccatctgttaagaattccatccacaggtctcattaataatccttgggaaaacaaggcaaccttcaggagcattgggaaaattatggatgcattataatgaagtcagagcaaaactgaggtgagaaattcaaacaccttctaaacgcggagctcctaaccagtggtccacgccagaatcatctgaacacagtgtttcaaaatgtgcattctcaggctccactgccagccattttcattcatttgggtgtggaatgaaacctaggcatatgaattttgaaaaagccttccaagtgattttgatgataattctggttaagaagagaaagcatgttctaccttgtcattatgtatctactacctttccagtagattgcaaactcttttgaaaggattctgtcatatttaccttgtgtcctctgctgtctgtagcatagctggactgtaagcttgaggaaggaagagagcatgctagttttgtttattatcataattactcctgcccacccctcccactccagtccacagctagaagagcacatggtctatagttggtacccaagaaattgaattaaaaaaatgaatactaggaatttaattatatccatatggatttgaattgattttcctcttttctgatattattgtttactatgtacccagtgagttctcaaatgcttattgagtgaacacactgaattttggaagttaaatatgagtcactttcaggggcttttgagtggtatttgtagaaataagtctcatgactttatattcctgccctctttctttgggcttctatgaaatatatctttggcttatcctagacttgctgagagcagcttaattatatcggctttcagaaacgtgagaatcaactaatccagactaacaaaacaagcagatacagttgatcctgtgacttcaagtaccttcccaagtggcattattaataaatcttgactcacagtactagcataatgcattatttttatagctaatgcatcaaaaagttatttgatccatatgaccatatgatttctaaggtcctataatctgagttctattctgaggagatatttcctatactttctagtgaagcatatgaaaggaaatgaagcagttctagtcattaaataattacttccatcagtacatacatagtatcgggtaataggaatatattataatagctcacctcttctatattattcaaataccatttgctgataactggaaataagaaagaatgctaaaattgattgacatctaacatgagttgttacttattatgggtcagcatcgaagctcatatatagaagagacgatttgaaatgttcagctagccatcttcataggaattacaataagttgaatatttctcagtatctttagtaaagatgcctatgccttatttacagtgtatttgcaatggaccaagctgaagctgtataaatgagacatatgctttgtttccatgttcactgttgaacttatgctccagaaagtcttccttattctcttctacccataatcttgcctctttttgaatccacatggcattgattttagagctcatttgtgcacttttcttgttctgtcttcttttagatttctaccaaattgtaaatacctatagggataggagcctcttttttttaattatactttaagttctagggtacatgtgcacaacgtgcaggtttgttacatatgtatacatgtgccatgttggtgtgctgcacccattaactcgtcatttaacattaggtatatttcctaatgctgtccctcccccctccccccaccccacaacaggccccagtgtgtgatgttccccttcctgtgtccatgtgttctcattgttcgattcccacctatgaatgagaacatgcggtgtttgttttttgttccttgagatagtttgctgagaatgatggtttccagcttcatccatgtccctacaaaggacatgaactcatcattttttatggctgcatagtattccatggtgtatatgtgccacattttcttaatccagtctatcattgttggacacttgggttggttccaagtctttgctattgtgaatagcaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaaggagcctttcttaatcatcctgtgtctcctgctatgataagcacatagcaggtatctaattgtagactctctgaattgataatcacttatatagaaattaataatgacaatatcttcttaatcccaagaataattacaccatcgtcattgaagtgaaaagagaacatttaatttcaagttttgaagtcttttaaaaatagatattataagctgatttaaagtagatcttttaacctgtcaccaaaagcatttattccagttaaaaacttgatccgtttatatattcatgcataatttatattccacccacttccaaaaattaattgaataggccactaaggtgataggtgatgccagttaaggaaattactaaaatatcagtaacaaaacctaccataaaagttttattcccaaaatcatcttggtatttttaaatgtttctaggttaaaatgttaaccacatctatatgctttatttctgtaccaaatagagtttgggaaggcttatttattagacgttttaaactagttcctagtttattatgtgattctatctcaaacatagcattttatattatttttcttttaattgacactgttttgtaaatgttaagaactatagagtgaatttaaatgtatatttaaaaacctacgtgaaagatactttaactcccgccttcaagtgaattcaaataaggagaattccaaggagtggggaaattagccaaacacttttccgtctcaggaaagccataataacaagaattataacctgttcctatttttcttaataggtgatttggggtaaggactccaaggaaacaagagcgttctgttctaagacagaaacatgaggcaaatggagacaaaaggagagaggagaccccaaggacaatagcctcccacattctctccatccaaggcacacatgccaaattgcattattccaatgagctctgcacaattaacctgtccaaaggggttgcgtggctgatgtttaactttccacccagctacgttgaaatgtacagtacatcttgaacatgttatttaaattgaaaatgaaacatctggacacatcagtacgagacgggtcccactaaatatgggaacatgtttacccaggtgggttcaatcataatttctactccgtgaaataaaatttcaatctcgcctgcaaaaactaaaaattaattttagagttttctttaaggaaatttttctcacagaaagaatcatatttcaattttaaatattggataatttgatcaaatgcctttatattaaatgtgctaaaaagggtttaagataggattacaattagaatttattaataataaatttctataaatagagttatatataagcagtcaaatcagagaaggcaggcaaatcctgtttgtccaataaagataatcatgtgatgaaataaaaaaaaaaggagttagatacaacttttttgagatgtacattgcccattggcttttagaaggcacatgtaacaaaagaactttgtcattcataaagaaatccataagtaattgggcatccacgaataatgatagtgagcggcaaaagttaaggacttcattttcaaagtcaatgttgtttatcaaggcctggaaaataaacccctgtttatttctaacacgccaaatgaaatcactgccaagtgtgagatactgtgataacctggaacggggagagaaagatctgcttgtagactggaaagagacctggtgccctgacctctctctgatagctgccaacattgccgggtctacgagtaattcagtaaactagtacgctccttctcaacatccccaccaaaaaagtcctttttccaatgtaagttcagtgctggtcggcctgtaggagtttcagcaaagatgagaattaaatgtgcttgcaggcaaaaacatttcagaaatattggctaaaaagtagactcattgcaacctgggaatagaaataaggtctcatgaaaacacttaaaaggaccaagcagagctttctacttgtaaataaaggcttctgttgtgtagtacagacagggcttgccaagcctttagcttgagtgttcttggaggggcaaagggaaaaaaggcagaaagggaaaagaatacaaggaggatttgggcaataaaagagacagccttgtatttgtacttcctcctccaccaccactgattccatcacactccctagctcaccctaggctctcctgaaatctgccccaagggttccttcttctttagttgtaccaatcttcgtattttctgtgaatggtgtcttgagaatgcctcacaattttctatacatccttctctgcatttggtatattttgtgtgactagctgcaaactcaatgctatttacaagaagtttaactgtcaaacacatagaggacaattctggagaggttgagcctagaacatgccaaacaacaggtatatgaaaacgcggggagagaacagcctattctccttgtgctgatgaactcaatctagtgaaaagcacaagtagcaaggtggattagggctggaggtagagctaacatgtatgagccttggttcctatgaacttgttcatacacgaacaggttgaggactgggtctctgccagaaaagaaaagaacctcccttggttcctaagataactactccaacccatagttgcctaggattggcctgatcaatgccttcctaagcactctgtaacacctcataactttagcactaacacccacggccttgatctatttttctgcacccgttcctatctgaccaggctaatctgcttcaaaactttgctaccatttattgggtagccactgtatgcctgctcatgtgttaggtgttttacatatatttgctgtgatccttgcaacttatattgttgcaactgtaaagtgtatgttactgtccccattttacagatgaaaaaaaggagacgcagagaggttaaaaaaattagcctaagcatgcaaaaaatgatggtatagctgagaatcaaaccaaatcagtctggctcccaagtcaatgttcaacgcaccaaaccttagactacccaacagatcttcagtatgctttccaaagccttccacgattccactgctccttccttccagctccttccttccagctccatctctgaccctccttgtggaggcaatagttaaatacttgttgtccaccatcccccatctcttcagtgtgtttatttatgctctttcctctgcctgaaataccactctccaatcaagcttagcacctcctcctctttccagatgtggtttcctcaagaaagactctctgatacctctctcatacacaagcaccctaagccatcttcatcagatcactttcagtagtccactgccacaatgatcaactttaggtgtgttcccacctacacagtagccttccaaggtaagaaacctgtctttgttaactttcacatctccaaaaccaggcacaatgcttggcataagcacaaactctgagggtgcttgttgaatggaattcatctgaaacttcagaagtgccttcccattgtgtcagggtgtgtgtgtgtgtgtgtgtgtgtgggtatgtgtgtaggcggaggaaggagggacagtgtgtgtttaatcttctcaactaactttcacatttttttgagagtagggtcaatgtcttctactttcattagtgtgcttgtctttcaaagctccttgcctactgcagacagcagagtgaatggccctattttcatgtcatgttaaagacacccatgaaggtgaactgaactatacagaagagaaaggtagccagggagctgataacaacagagaaaaatgagaatttactcagcaggtggatctcaccaacttgcagaaggctttaagattctaacaaaattaaacaatataaggctagacaattaagaataaatattgaatggagacagcctaaaaagaaaagtaggtattaataggcatttgaaatgaaccacttacttcaatttaggcactaaatttagtaatgcttcctgacaaataaaacaaagtcagaagccattcagtaccatgacttaccagtattcgttcacagtggtttaaacatgtaagggctcattcctctcatggggatctaaagccagtggccaccagccctgattcggtagctggatcatgtcagggccagcatctctgcaagtctgttggtcttttccttgagcttcttgcgctgcaagacagctgctgctgttccagacatcacatccaggtttaaggcatgaagaagggaaggaggcttaataaaccatgtctgatccttatattaggaaaagcaaaagcctttatagaccacttctgatgttttactgattcgaactatgtcacatggtcactcatagctggaagagggttttaaaaacatggcttacttgcagctaggcacattgctgcccagatcaaaactggcattttgttcgcaaggaggaagaaagtaatatgtactagattaaaaactacactaattgcagattgtagttttcattgtctgctaaaagacttcatgtaaaccccagaagaaatttattacacactttaataactagttgatgaagtaataaatacatgtttggtcacctaactgaattctttggaaaaaacacaaactttttctttattttttataaaagtacctgtgaaaattttggaaaataaattataaaatataagaaaatagtgacctgtaatcatgtcccccagagacagaatattttgtttgaatgaagaatgcagttatatatgtcattatagaatatttagaaattactcagcacatataattaatatctcataattctaccacccatagaacatagagcaattttggtcattttgaaaagagaaaataacttttcacaaaattttaaattatatactttctttaaaaaatacagacattgaaccaaaattttctataaagcgtaaatagcatggccataaatttgtgtacaaaatttaatctgtctcctatcattggacatctaagttgcatgcattatgaagaaccctagcattaacattattatagataaatttagggacaaattattattctttcctagggaataaatgctagaagtaaaactctagtggcaaatgtattaaaccttttcaagatttttgatacatgttaccaaattacatatgatatggtttggctgtgtccccacccaaatctcaccttgaattgtaataatccccatgtgttgaggggggcgccaggtggagataattgaatcatgggggtggattcccccatgctgttctcatggtagtgaataagtctcctgagatctggtggttttataaatgggagttcccctgcacagttctctctcctgccatcatgtaagatgtgactttgctcctcattcaccttctgccatgattgtgaggcctccccagctatgtggaactgtgagtcaattaaacctctttcctttataaattacccagtctcaggtaagtctttattagcagcatgagaacagactaatacatcatgtcagaagagttctacaacgttcatcttaataataataagacggccatttttcctgaaacctgggtaatgtctatacatatgtatctgtgtgtatttatgtatacttacatgtatcttatccaatggcaaggttatatatgtctatatatagattattatgtatatataatatagatatagatatatatgagatctatatgtaaacttgcagttagataagttaaaaactggcattaaataattttgcttaaattagtttttctgtgattacttgtatgagtaaacatgttctaaagtggcttattaaaaatgtgtgtctttttccatattgcctgtttatatactcgtctgttttccattgagatagttatatttatttgtatgtgtagcttcctatataaatagtaattcttatttatgaaagaagtatacaaatataataatttatttttggatttctaattttgtttatggtagtcttggatttctctaattttaaatatagatctttttggaagcttttaaagaaacacccatgggtagtatattttcaaagtcattgcacatatgataaaatctttctattgtcttcacatatgccatggacggcaactgtctggatatatgattttttgttaacatcctttaatgtcaaaattctagttacttccttatataacttctggaattctgtgttgtatacaattctttgttaacacccttttaaacttcaaattctagttatttctctatctgacctcaagaaattaatgttgtaaacaaactgtctaaagttagtctgacatggttcctttgtagctaacttttcccccgtgtgttctggtttttttaaaaaaacattatcttttaaaaagggaaaacccctgagaggtagtttgttagcatgaagtcttctcttttttattaaaatttaatatctcgggggcacagtgagcatgtttaaccttagcatgtgaatctttttagtgcaaaaaatatttctttagctatgtcttggtcattgctccttaaataggtgtacttctttaggaatactggtaaactttaagtgggttttttatatgttcttttatatctgctatattttacatccttgtcctcaactctttgtcctttttagctacattcctaaagatttcccagtgttttctctaggtctttgatccagttttctatagtattaattctgaccttcattatttccaatgataattcagataagtctattgcacttacagttttctttcaattctaccctattttacccaattcttgcttggttttcatcctgattttttttttccatttctttcacgtctttctgctcctgtgtcatgaaaggcatgtctacttgctgcctatttcaggagccaaatattaaatatcttcttttagccatgacagtaatttattttcctatgtgtccttaggataatttccttattctgtatttttttttcaaaattctcacatataggatagactgacatactcagtatttccaattaacaggatatgtgattggcctcagagctctcacttatttcagtgttgatcgtggcagattctcctagccccctgtccagtgtctaggtagcattcaactggagtagttatgctagattggtgtgatatcttttattctcaatatctggttctttgatccataaatttgaatgctgttggcccttctaaaaattttaccaagtgttttccccaaagagttttgaatgccaccttggacttccacttatagaactgctagaaatgtgaccatcacagacgtttaacgaagaaattaaagtagcaaccgctgctaaggtttttgagctggctggccacagaggggatgaccttctacctataaagaattcttctctttaggaagaagcagaatgaagcaaagcagaaatagaaaaactctacattcatacttgggcttctcctatggatttaaatttacaaactagctaaataataagtaacaatgtatactcaggagcataataaatctaggcattctcctatatgattcatctattcactattgactatagtgtatatgggatcttggtgggggaaattgtaattactcatattttaataaagacagtggtactttattaaaatatttgaatttgaaaatgttttcaataggcggaaagccacagcccagctcatagcagatgactgaatgagtacagacctttttttgcaagaataaacctgaaaggggtgggagctgagatggaattggggtactctcttcttcctgtctccaagaggtagcctctcagcgattggaagagcacattgagctgagaaagctctaggtggacaagtcaagctccaaattgacccggcagcacaccccagggagcagctgtatgcagaagcactttatgagtttccaattgtgtccacaatctattcaattccagcgcactatgcttatttactgtacttacagcaattggtagttttactgtacacaaaattcctagttttcatggacagttgcctcagtgcttgagatttatataatgagagagaagtgtgcagacacaatgattattacacatcccgttgtcctgagctgagcaatgaaatagaaagcagaatgcctacattctaatccagccttgggccctgtctgaccttgggagtgttcctgaatctctaagtttcagcttccatatctggttgaacgatatcatctctaaagtcctttcagctgtaacaccctacgattctcttttcaaatagagaggacatccttcctcttaccggacactaagagggtttactttgcaaatgtggctctcagaattttatagttgttcatttgaacgtaaacagaaaatttgtttatgatgttcttctccatactgtagtttgggataagaagggtgcattttttcaatatgttcaactttcaaaaagacatgctggaggaagtcagccaatttctgcccacacaacttccaagtgacgtcaatggaagcagagcacacagatctctaggcaagttttggctcattatgtgaaggtttttttttttttctttttttaaagaacaactgcaaaaatgattgctctcaactcaaattacacaatttgttcttctttgtgccctgagtcagcaatagacataatgtggaaaataaagcaaaatctcctttttacacatcaaataaaagagtccatagttatctgaaacacagaatatttgagattttgagcactctctaagcaatatttcctcttgctgtggcctctgcttaatttcaatatagaaggttgatcaatgatcatcagatggacaactggaaaaatatatctactttttcttattttgatcctagatttgttcttcagtcctgcaattgatcttgtatatcattggcttattgcttaacccttggaagtattttaaaggacttacctgacaagcagatataactggtgttttgttagctcagcttttcacaaataagtcaaatagttctgttactatgactagaagaagaaaaatagctaatagaaatgtagctgttagtatataatcggcacatcctggctcaattatcacagcaaccctggaaagttgatgttgttattctcctcattctactgattaggaaacaggatgagagaggttaaataattttcacaaagtcacagcactgagtaagtggtatttagattccaaaccaggcagtctggtttcagtatctgtattcctaaccacaatgctatctagataataatttattcttctaatcaaaaagcatttaatgatgcctaattattctaggctctgagtagagtcagttactaggtaatgtggaataatgacatgggaacaaagggcaaagataagggagggaattcagattttctttgcacctaaactggcccaaacactgtactcaacacctcacatctatttcgtctttgcaaaaactgtataagcaaaggttgtatcagtggcattttatggatgaagaaactgaattgtaaggaggttatcacttgctaaagattgcacagctggtaaggcttggtaaaggcttgagttctaacccatctgtgtgtttctaccacctacacttcctgtactccaatatgctgcttccaggagtatgtgcaagtgaaatactcagtttagtgtctgagctagaatgaggggcacacaaagtttctcctaatattggggaagctctaaaagttgtttaggggtaatgtcaaccaaaccaaatttctacatttcagagcttctcctatagtattctactttagtctgcattgcccaaactgtgctggaaggactgccttcaagttcagggccaaagaggtccatgaacaaattgggacataattccaatgaatagcacacacattagaattaaaatagcatcaaaacattaaattcctttttaaagtggtaataaatgagttcagtattttatgtacaaaatcttgtatttttagagaaattaatagaaaacttttgcatgaacttgcatagcttttcatgagcatgtacagaaatgaaaactggcatcctctatagggtgccctagaaggaccattctgtaaacattagaaggtgaaatatatgagaaatctgtaagaaagtacttttcatttttccaaagcaaaatgcaatatagatttagagttgctttatttttcccttttttatttgaatagaatgcttttcctaaaaaatattaccaactaagtaagaggcagtttggatttaaattgttctcctttcagagtttgttcccatcacatcaaatgtcttatttatattcaaataccacagggaatgggcaagaaattgtatgtttaaactggactttttcaaggcttttaaggccagaatattttctttgccaaagactaaattattgcaaagtggggcaagcacctgaccttgtggcaagtcagaataagtaaatatctccacctggaattggaaaccaatgctcccaagaccccagagcatcatttattagcctgatggcagctttctgcttgttgctggctgagcctgattatacatatgaaaaatgggaatcacccagagattctctcaccctaacacagagcccactttgcttatgtacttgctcttgcaaattccattaccttccacgccaccacaaccccttgaaaacccagaaatacttatagacaacagattaccccagtccatcctttctccatttccaaatgggcattctgattacatttctaaccaactgtcaatcaagggggtctcaataaattctctttccaaccatctcatggtaatagtatgatattaactatattatatcaaacactgtgatgtaaaataactttgacatgtgtagggacatagtcttacttttagtcatagcatcgacaaaattttaatgcatttcttaacttgactctccttcatggggatatacagggtctctgaagagatctgtgtatacctgatcagagactggccattcctatccatcctgcatgagtaacacaagatatgactcactgctgttcattaacctcatagagttcatttaccttctgcagaagtaaaattgatttgctctttgtaaagctgggtgacagaacttttaggattcctggaagtcacattcaggggtggttcatgggcatggaatctgtgcagttgcacagggtcccatactcagaaaggctcatgtttggttggtttaacgttttgctgtcaccatcttgaaatcattaataacttctgaacaaggggccttgcatttttattttgcagtagaatctgcaaattatgtggccactactgaccacattatagtatcagtgtagcaaatacagttgattgaaaataaaagaactaaaaaatcaaccaagtgccactaacatatttgagagttttttccaagtaagatgttgcatttagtaaattgacctgagttttattttattttttggtaaaatagtcccgttttttagactgatgtaattctcaatgtgttatgatgcatacatacatgcgtgtgtgtgtgtatgtgtgtgtgtgtgtgtgtgtgtgtgtgtgtgaatacatttttaatggttgataagaaaattgagcaggagggaagtgacaaaagagaaacactaaccagattccaaagtctttttacttagttgtggctaaatgcttaaaacatccaatacggtctcctttcactataatcatcacgttgcctctttcagagaattcacattcctgtcttatttttggattattgtaatttataaaaatattgcagatgtgcaatatgtcactaaagctgagcttgaacatggccgaacatcgtggaagcctagtacctgaatgccttcctaacagtcagccgagcacagcccgtcttgccatgtttctctttctttctctgtgtgggtgcgagggtgtggggagtgggccagcatgacgctaaacgcactacgcaaaagccagcatgaatcccaggcctttttctggacagaaaggactgattgtgtggcgagcagctggaatgcgtgccagtcacttttggagtggtggtcacaggcatcgttttgctggattgtttgaggagaagcaggacagaagggagctctcctgccctgtgctgcggtgaccctgtaattttcctcctcttctttgttcaaattataaagaagagtcccacatgttcggaaaacttcagcccggttttttcaattggacgctgctgtttcaaaagtacaaccttctctttctggttgcttggaagtgacggttcaggaagtgtgcccacaatgacatgagttagggaactccgcagagcaggcctatggtggagactcaggatattttagtcagggtctgtggataaggcccatgttaggacagtaaaaagcttgaaaaagaagcattttagagaacttattgtataaatggttaacgagaaagccagaatgatttgtgatatcttaaagtttattttaaaagtttcagattctttacaaaacaagcaaaatctttacccgttgaactacttatagatctactggctatgattttacaaagttagggaaactgcaagctctccctttgtcctactgtttgatatttagctattatcccatcagtcgaggtctcagtcttctgaacagtcatcattttacaccattcccaaatggatattctgataacagaacttacagctcttgcccacccaatctcacctaccaagaatagagattatagatgattataccatataagaggaagacgctagaaatgtcttccctattttgttatttttgttggattttattcttcaaattaaagtaagagagacttgaagttctggattatatataaattctctgcaagcacttgcttgactaaatggtatgaacgtacttatatagtgtcctgatgtaatgactcatacaaatacttttcatagcagaaacatttacatgtcttcttttgactcaaatgttaatgaggtttgttttttttttttttttttttttttttaatcctctaggcttttcccaggatgtcattgtggaaaggtggttaatgagaaatcgtttgagtctaaatgcatttttacctttcatattatatagttggtagggtaaccaaacttaaccagctaaattgacccctaattgcccacctacctattcttcccagctcatgaaaatctctgaaatgacatggcaaggtcagaggaaagcaactgatgaatgctggtccttggtgaactgcaaactctgttcctacatccaggaaatctctgctgaaatctctgctcagctctcatttggcctcctagctacagctttctgctgctgctttttataaaattcctggagaccctccctgcacatgcaggatttaggagtcagccaacaatttaagaagacttggtagagagattttgacattccttccacctggctcttctttgagactaccttccatttccaactcttctagcagccctaaactctgacctctgtttccttaaaccagtaaaattgtgcctttctacttggattctctcccctggcaccccaaagaattacagagcttagttttcacggatcaggcctcttccagtttctgcttgctttggttgctcagcggtgcttttagtcaattatttgtttatattttgtctagtttctatagttgttatcagaggagaattagtccaatacaagctactctgctatgctcaggcctgcaaatctcaaattactataattaataagagaatattagaaatgtgctggttaaaaattgaatgtacaacattaactgtttctatatgcctagaaaaagtagttagacaatgtaattttaatttacatttacagcttagtacaaggatataaagtacagaataatattcctaaaaatacatgtaatactcttatagataaaattataaaacttattgaataaacagttttgaaaaactttgaagaaaaccttaataaagacagatatatcctgctcttggatagacttgttataaagaagatattcattcctcctatagggaggaaatgggcaaaagattgaaaagacatgtcatatcaaaggaaatagaagatggcccctaaacatttgggaagatgctgtaactgaaaatctcaggaatgcaaaattaagttcttaggagatattatttcatatttaccaaattggcagaaatttgaaagttagataatattttgtggagtattatgaagaaacaagaaggtttgtcaactgcttttttttttttttcttgagacggagttttgctcttgtcgcccaggctgaactgcagtggtgtgatcttggctcactgcaacctacacctcctgggttcaagcaattctcctgcctcaacctcctgagctgctgggattacaggcatgtgccaccacgcccgactaattttgtattttttttttaggagagaccggggtttctccatatcggtcaggctggtctcgtatcccaacctcaggtgatcctcccactttggcctcctaaagagctgggattacaggcgtgagacaccgcacccggcctatcatctgcttttaggagtgtaaattggtccaatttccttagaaactattgtcatcacctattttacaattcagtaagtttactcctagatatttacctaaagaaacatttacatgtatctgtataaaaatatttataagaatatgttaaaaaaaacaaaaatgaaacactggaagcaactgaaatgtctaccaagaggggaaaggataagtacattgtattatattcacacattagagtacaataccacaggcaaaatgaataaaatagagctatatctcaaaatggaggaaacttgaaaatctaagtttgaaagaaggaagcacaagtatccaatttgttcccatttgcaaaaagttcaggcaacatacaataatatgctgcttggggaatacctatgtaggtgggtctagtgagaaagaaaagaaagagaataagataaatttctgaatggtcaaaaaaacaccagcatcaagtagaaaagtctgttatagtatgaacgaaatcacagagaatttaccacaagtttacctggtatctccagtacctagaaatatttgcctttttcaattattataaactaatctatgcatgatcaagataagtggattttgttagttaaagcattaagttatcaaagtgaactttggatcttatgttagttatgacaatatttgagaattcagttatgttccttaacttttaatataaatgactttgtgttttgaattgttgtggggcatgtaaaattgttgttaaattactgtgaaattttaaaaagaaaaaaaaattcggagtggtcatttcctctggatagatgaagaggaatgcgagtgtgtagagaaacagaagggatctcagaggtgtggtgctgtcatatcttctttcgtgccctgaagatgggaacatgggtactctctgatcattctttaaattgtgcattaatagttatatattcttcctataatcccagcactatgggaggccgaggtggacgtatcacttgaggccaagagtttgagaccagcctggccaatgtggcgaaactccaaaactacaaaaattagctgggagtggtggtgtgcgcctataatcccagcttctccagaggctgaggcacgagaattgcttgaactgggaatgtggaggttgcagtgagccgagatcatgccactgcactccagcctgggccacagaatgagaccctgtctccacaaataaataaataataaataaataaataaatattctctttgtatgatagttcataataatcatatatgttatttttatatttttaattttattttatatttcaccaagtagaatttttaactgctttctggagttgctgcgggaagatcaaagtgtctacgcaaaagtggcctggtgatagggtggggcccagagcccagtgctggtggagacaaaagtgcaaggtacagcattgcaaggtcagcagccgtagactcggatcctcggcaaacgcaggtgtgatcttgggactagctctaggctgaagagctcacatctaattctccagcactatgagccagctagtcttgtaatggcgccctctactgcttacatttgcaagagactgttcctgttgcttgctacctaaaatcctgacaggtgtattgcttttgtagtgtctgtgggaataggtgaggatatccaataaggacacttgaaatatgagtttgaaatttaggaatgatgtctgacatgcgatatagctgttaccaatatacagtcatttgtgaacacagctaagttcaccagggagggtgtgaaactcaaagagtatgaacctcaaagcttacccactacaacatccaagggggatccaactcctcacttaccaatatctgtgcttagatggtgttgggacaatcttggtatccacaggtcccactcctctagaagccagtatcacagtcagcactttagaactgtcagtaacaccgaggttatacaagtaactactcactaattgtttgttttttgttttgttttgtttttcacttttaaagactttcttttttacagaagttttaggttcacagcaaaatttggaggaagatatattccccataagccacttgcccccacacaggcatagcctcctccattatccacatcccccaccaaagtttgctacagttgatgcatctacaatgacacatcattatcatcctaagtccatagagtcccttagggttcacttttggtgttgtacattctatgagtttggaaaaatgtataatgatatcaatccttctttatagtgccatatggagtattttcactgccctaaaaatcttctgtgttccagccactcatccctcccacaaccccggctccacccactaccttcaccaccccctgcccccgcatctaacccctggcaatttttaaactttttttattgcattatctcgacacagccaaggagattattttatgagaatattaatgaaaatttccccaagagtaaccccatattcttagaaaatatctgaccatcattctgcatgattaacctacattctggtctcagaagcatgactaagaaggagtttaaaaaacagattggtggggcagtaattatgcagttgataacacaaggctctaccctgtgtacataaatctttcacaggaggaaaaatatttaaaatgtaagaattaaaaagcaaaaacatttggctataaaaagggattcagtaattacaatgaacatctcattaaacatagtctttatttacaagaaggctgggagagctctaattaactcataagctgtccctatgaatcattagctgtggcaggaaaattctaggtgatccattaaatctccacacccacagctgttcagggaaaaatataagcaaaccctaactgcccttattttggatggttggtgaattttcttcagtgaccaactggatgaccttggccaccacacatcatatatttcttctccccaggggaaactgaagtcctctttttctataaccaaggataggattttctcaacactcaacaaatagtttgtccatctttgaacaaacttttaaaccaacgtgatataaacaatttacaaaagtttatggtagactttagatgcaaatccttgagttgacccagaaacattctgctgttttattatgtcagtttcctaagtctgtgtttgaatatgatttttcaccatgctatctatgtgtttttgtgtttgctgtgtatgagaagacatggtctaattattaggggccaggcactgtgaacctatgcagaaaaccacaaaagtccaaatctgcactatccaatatggtaactacaagtctcttgtagattttgagctcttgctgtgaagctctgaattgagatgtactacaagacttcaaagagctagtacaaaaaaagtaaaatatctcatgaaaaattgtataatatttttgactactagaaatatttagctgctagaaatttttaaatttcatatatgtgccttgcatttgtagtatacataatatttatattgaatggcaggacaagtggccactgtgagcccaaagtacacatggaatatttttgaaaagaagccaggagttctagagctatagaatttcctatctggaagagatttccaaaagtaaatagtgtaaaagtgcttatatttgtccaacatagccctcactttccaccacacacacgttaacacatgtaaatgtccatgcatgcaacactgtgaccagcataagcgaagagttgctatacattaagagtttggcatcactggaagaatctcctacctagtacagttctctctctgtatccctgggttccacatcagcagattcaaccatggcaaaatgaaaatattagaaaaaaatgaaaaatacaacaataaaaaaatacaaatttaaaactcaatagagtataacaactatttacatacatagcgtagcatttactttttattaggtattataagtaatctaaagatgatttaaagtatccaggaggatgtgcatagattatatgcaaatactatgccattttatattagggacttgagcatctgcagattatggtatctgcaggggttctggaacaaatcctccatggataccaagggactatatttctaaatgttggggatttaaaggaagaatatacctgaaagaagaaactgagagaacaagcaggagagatcactggctgaatgaatggaaaagtgaaggacattccagaaaaggaaaataaaatgagcaacagctgagaggaaaaaataaacatgggtctttaggagaatagtgacagttgggctattagtaacaataattaatatctgaaaatagcttttaatttacatagatttcatcacaggcattatttcatttcatcatgatagatatctatttttatcattcccattttacagataaagaatgaggcccaaatttaaggagcttgcccaagatcacacagtcggtagtgccagaatttaggggatcaaccatcctgtctgccctgggctggggtttccagcactcaggactttcagtgctagaaatgagaacatcctgggcaaagcagggaacttgctcactctacccttgaacccatgtcttctgactctaaatcccattctctttgcattgataataatgacaaacatctattgaatactttaggtgtaccacgaactttgtaataagaacttcacataattatctttttaatctacaaaacaactttataaattgagtattgattttgcacttcctcctcctaccaccccacatagtccagatataaaaaaattaagtctcccagatcattgataacttacccaatgtcacacagctggtaatgtctggattttaactcaggccattccagtccagggcctgtgctgctaaccaccatgaaagatgcccagcctggtgctgccacctcacctgcttgctaaggcccagggttcctgctggaccttttgacccactcctttattttttcatcatgttagtatgaaaacatagcttgactggaatccagcgtccactactgcggtcactctttagtgcataacacctatgcctcctggctttgatcttgccagtcttccatttgaaatgacctctcatattaacatcctaccaatgcctgtcccaccttttagtaggtaccttgattcaaaaagagttcttaaaaagtaaaagaaaaaaagtttccttttcatttaacatgtactggcaagagttgccagataatttgtctttaaaattaaaacaattatgctttctttaataaaaccctagttttttgttatcacctttgatgtaatttttaaaaagctgttctttgaaagaatatgcattatttttatatggcagaactttacaccatttgaagcaccagaacagatataaaatgttacttcatgttatcattcccagtatgagaatgatgagcttgtcattttcctaagaccgtaaattcctgagtaaaaacaactatgccactttttttctgtaacccacacatcactgacatagtgattgacatatgttttccagaaatgaattgagtggagtatagcgttgagtgagtgtgagatctcactggcctcactggcacagggttgaagccagaggattttgagtttcttattgtctgtggctttaagccttgtcacttcttcctcctcatgcctcaaccttccacaggcatgtattctaaacagtgttgatatgtagttgccacttcagaaagagaaactgatgttggatatttaaattatttaccttttcattgacatataatttatatacattaacatttgtccttttaaattccttgagttttgacaagcatatacaactgcatatagaacacaagcagaatctagaacatttctatcactttagaaagttccctgtgctcattttttgtcgacccctgccccaccccacttcccagcactgacgtgaactgctttctgtccctatagatctgccttcccaagtcatggaatcatacagcagatagctttttggactggcttatttccctttttataatgcttttttttttttttttttttttttttgagacggagtctcgctctgtcgcccaggctggagtgcagtggcgcgatctcggctcactgcaagctccgcctcccgggttcacgccattctccgcctcagcctcccgagagctgggactacaggcgcccctaccacgcccgctaattttttgtatttttagtagagacggggtttcaccgtgttagccaggatggtctcgatctcctgacctcgtgatccgcccgcctcggcctcccaaagtgctgggattacaggcgtgagccaccgcgcccggctataatgcttttaagactcattcctggcctggcgtggtggctcacgcctgtaatcccagcactttgggaggccgaggtgggcagatcacgaggtcaggagttcgagaccagcctgaccaacatggtgaaagctcatctctactaaaagtacaacaattagccaggtgtggtggcaggtgcctttaatcccagctacttgggaggctaaagcaggagaatcacttgaacgcaggaggtggaggttgcagtgagccaatattgtactactgcactccagcctgggctacagagcgagactccattaaaaaaaaaaaaaggatttattcctattgttgcattcatcagtattctttttcattgctgattattattctaatgtgtgtataccaaaatttaactgcctattccccagttgacggacatttggagttttgtctgtcacatataaagtggccaaaacagcacgtaggtcttcgtgtggatgtatgttttcacttctcttgaataaattcttcggagtggaattgctgggtcagagggtgggtgtatgtttacctttatataaaactgccaaattgtttttcaaactccttgtaagactttgcattcttgccagcaacatatgacacttccagataatccacatctttgccagtatttgatgttgtcaatctttttaattttagctattcctgtaggcaagtctaataggtgtatctcattgtgggtttaatttgcattttcttgcaaatacctttaatagaccttttggggggtataattcgtatactgtacaatgttctcatgtgtcaaagttggtttagttttggcaagtgcgcaccccttatgtaacacacaccacgtccaggtatagacccatgccaggcccccggaaatcgctctatgctctgtccagtcaatttcctccatcacaaccaaccactgtcaacgattttttccaccatagattagtttcacctgttgaagaacttcatccatgtagaattatacggaatgtgcgtctgtctgtgggctggctccttttctcagcctgatatagtctgatggtcatctgagctgcagtctggtactgctgtgcattacctttctttgctaaggagcttccctttggatggatgaaccacaatttgtttagccattctcctgttgataggcacttagttgttctcagtttttgtctactatgaataaagctactataaacatttttgtgcaaggatttttgtgaaggcatgttttatttctcttgaataagtagctggggcagaactacacagtcataaagtaggtaaattttatctttataaaaggtcaccaagctgtttttcccagtgactttcccattttgcatttccacccacaatgcataagagtttcagttgctccacgtgctgccacagtttcttctgttttgttgttgttgttgttgtgttaagtttagccattctaatgggtgtgtggtggttttaatttatatttttctgatgagtaatcatgtgcttattgcccatttgtatttattcctttgtgaagtgtatctactcaagtcttttgccctttttttcttttcttttcttttctttcttttttttttttttttttgagatggagttttgctctgttgcccaggtcgcagtgcaatggtgcaatctcggctcactgcaccctccgcctcctgggttcaagtgattctcctgcctcagcctcccgagtagctgggaatacaggtgaccgccaccatgcctggctaatttttgtatttttagtagagatggggtttcaccatgttggccaggatggtctcgatctcttgatcccatgatccacctgcctcagcctcccaaagtgctgggattacaggcgttagccaccgcacccagcctgttttgcccttttttattgggttatctgtttattactaactgtagttaattgactggcttgtagttttaaaaaatatattctacatacaatttcattgtcagatatatattcagaatgttttcttcctatccatggcttgagagaagtataatatatcttcatggtttataatatatttttaatataatttataatacatatttaatgtaattcatatcttataaagtatctgatgaacggatgttttaatttggcagttgaatttatcaaaaaatacttatagttcatcctttctgtgttctatgtaagaaatctttgcttaacccaaggttgcaaagataatctatgtttccttctttgtagttttcacttaatttaggtctacaatacataaaattttgtgtgtgtgcatggtaaagtaatactacattattacgatgattgcagctttatagcaggttgtaaaatcaaacagtttccaacattaggtttcctttcaagatggttttggctattgtaagtcctttgcatttccatgtgcatcttaaaattaatttgtagatttttacaaaaagtctgcagggatttttttcaaccttttcttattctttgtttgcataggttatttttttttccaaattttccacgtcacttatttttttcttctgcagcgtcacgtctgctgttaagccctacccaatgaatttttaacgtaggatattatattttttaattctaaaagtttcatgtggttgtgttttacagtttccagttttctactaagatttgttatctgtttacccattatatttctttggaatccttaaatgtgctgttaatagctattttaaaggcttcatctgctaatttcaacattgtcatttcaagtctgcctctattgatttgttgttgttttttttttattgttgttgttgttagttaaatttttcatttcctttgcacatccagtaaaattttttgatatgctggataccgtgaatcctaactggagaatctggattttgttgtcttcctttaataattgttggattttgccctggtaggaagttaatttacttatgaatcagttgcttcctttaaggcctgtgaataagctttgccaggacatagtctgcagggctaaagtggcctccctcttaaagtatggtgattggagatctcagctgcatgcccaaggtgtcggtgagcccgctctcctttggttggccagaactcttgtgactcccagctctttgtggccctggcatcttcatttcactcacagctccccaatagagctacattgttgtaccttgtagtttttccctggacatgaacgaggaggttaatatttgtccaagtcttaaaagaacctttatgcagatttctggtctttcttctctatgcagtttctagttctcttctctctgggtggctggttcaaaattctagcctcaaactcaaagtgtgttcctcctcaggtcagcaagatccctgggttctgctttggctcctcctccctgtgcctagacagagagctggggcaactggagggctcttatcatggtattcctttctcctaggaaccataattctgctctgaatgttttccaacatctgaaacagttgcttcaaacattttgttcagttttgtaatagtttatggctggatgaattcatcattactgattattttgtcatggctgggaatggcagctacccatatcattatttatgaatctaaaaaaaataagtatactaggcctaagacattttctttatctttcacatctggtgtcatctctgaaaccagaattccagttttgtttctgtaccactactagaatatgtgcagctatgaagcagagtgaaagtatttgcaaaagacagcgtatcccctcctgtaagatgaaagtccattaaataaattaaataaataaattttaaataaattaaaaaatatttggaatttcaattttatttaaagcaagtttacttttttattataaaagatagctcctgtgggtgacttatgccacacaggtgtttaaggtggaaatacaatatcttatggcattttaaggcattccatttatgcgtggacagggattactatcagatttctctcatgtttgaaatatagtatctaacattttataatgaacaaagtgtttccgatcagattatcactataagttggctagtatgttttcacatgggaattgttttgtgttgtgtttatttcctctgcggtattatgggaaatttttaaagctaactgccttatgtattcattttaaaaactccccaaattattattcctaataaagggaaatatgaaagtatcaaaatattattatatcactttttcagttcaactgagtatgggagttactctcccgggtaaatgtgtgttcagcttgtggaaagaatcataaatgtcttctcaaaacaaaagaactcctctggctataataggcagagagaacaagccaagccaatctttccacttgtgctaccgaacgcctccttttttgaaagttttcagtttcaatggaaaaataagggcagcagataatgaaccctttattcattttgacctaacaagaggccttttaggaggcttacctagggaaccagtcttccagatgttaccaacgtgactctgtggcttattatgacttcttgaagaactttgctaagaaaaaagaaatatctaagatactgccacccaataaaatgttatgaaaaatttctacacttaatcatgtcctcactgtgaatcgctctattagtccctacaaccacatatagattttctctcaacatgacagtagtacatccctactgtgactacataatcctcattagattacttgtgtcatatttattacataggtggtctttaggcaaagcatactatattttctttttcctagtgtttcaatatgaactgcatgggcagaagcagcacaaaatagaagagagtttaaattctgatcctgccatttactaaccaaatgactttgagcaaattatttaacctttctatgattgactttatatgttaaagggttgttaggatagtatctgatccacgaaggagttgcgaaaattaaaggagttaatacaggacagaacagtgcccctcacattgtaagcactgaagaaactctgcctcatctgttgtttttattattattatcattactaccactactgtttagagaactctttaaaattagctcatttagccttcacaagaaatctttaaagtaaatattgctatccttattttataaataagaaaaccaaacttaaacctaggtctcctgaccctaaaaggttatattcttgtcttaagtatcctagataatgttgaaacattcagattttttaaaaagtgatcatgagccttcactaattttagcttagtcattttctttaataattttataagaatatttgtcgtgtcatccaaaaatttcattggcaaaagagaattcaagatcataatgcatttctataaatagaaaatgtgcctatatctgcttcatatcatttccaattagaatagagaacacatagattatagaatgagaaaaagtttaaatatttaacacctaggttggcatatagcatgtcaagtcctccccatgcttctttttccatctaaatacatgtatcctaaatttctgatctcttagtcttttgagaagttatttctttgatcctagttttcaacatctaggtatacatgaccctccccatcaatgtgggcagtttgcttttcaaaccatttgcagctccacctcctaaaagaccagtctctctggactatttttgtgtcacccatatgatagtgaatgtttttccattcctagagcaaagtctccatgagtctaacgatgtttcagaaaaagagtcacctaaatgccagtaattacatcaagttatcaacccacagaaaaataaccacagcatatgaagttctcttggaatctttttaagaatcaacttagcctgagtctgtgatttaggttcctttccacgtcttttaagagctaagcacaacctaagtagaggaaaagtctttgaagtacaagctggttgaccatttcctgcgcagagtatccaatcccattgaaaatgtcttggaattgtccctagcttcatcagtaagtgctgggggatgacgtcactgcgggatttcaaccgaactttatgttctgataaacaatgtggtgctggtagtggccactggtgaattctttttctcttgggaggtgccagcaaagttccttataaattttcaagctttgttaaaagaataatagagggtaagacagaaagagcttgggggtggtcaggccccgaggaggatcgcctattaaagtcagtgagtgtagacgacaatattttggtttagtgccacacttctttgagtataaaataagaaaataactgtcgtttcttggataacaggctatttccaacttaccatcacttgtctcgtgtgtcagtcttcatcctaaccatgtggcagcatgcagatgacaagggttatcttgaatttaatccttttcttagatggacagatatattcaggaggctgtagagttcaaaagtggtggtaaaagcccttccagtggcaacaataacgatgaaagaacccaacaggcagttttgtaagctttaccctgaacaaaagccaagagaacattgcttgtaaccaaacaaggaataaaaataatactagagtttctacagaaatcagtgcatggaaattccctgcttattaagctgtttccattatgagatgttcccctatattaaaattttcatagcataatatatccatcatctggacattctgaagatttttttttcaaggaaaactacttcagtaattctttataaaaacaggtttccattttctttaagaaacaaggctgatttgccaatgaaaataaataaatagaatatatctcctaatttttattctaataccttcacagaaaattaaaccaggtaccaaaaagtcatagctattgggtaggttgtgagtgtatcaaatttggacgaatattatcagatcctaaattaatacaatcagagtctctttctaccctgttctccacatccctttctactataaaaaaataccccttatactttcatcccaacctcctatccttcccaaaagcatccccaaaacaatgaaaaataaaacttactggagtagactgagaacaagcagtttagaactctctccctcattcaattcaatgtacctgaaatgagcattagtattagaactcaattcatgagggttatttttactgtagttatatgaaataaatcttggggatttaccttagagattgcataaggtcaatcttgcatccaagtttttactaacattgtttattctaactcctgtttccttttaccctcctgtaaactgccacctcaagatctctcaagcctttatttcctcacatacaactctgggtaaggtaagagaaaacacaagcccagagtggcattttatatgagtcagtaaggtacacccatgtatcaaatggcatgggaaccagggaatcattttgagttactaggttcagtagtgaaactctgtagttttcttggcccttacaaaaccaggtcacagctgcctggcttcctaatttggtttgatgtactgtgaattcccaagggggtgagtcactctcttattcatatggaagtacaggagccattccaaaacaaaaaccagtctgggtttatttatgattttatatgccctttactgccccactatacagatgatccagagttgactttcagctgttaattaccatattggagaggagatacatggcatttttcatcttttgagttacaagacttctttaatgtgaatattccctaagtgcttgcttgcttctgcttttggaatgctttactgaggctggatatatattatgaaacaatgaatgcaaaatcaatcacacatggagaaaatcaaagtagtaaaattaacaacataccttaagaaacagtctatgttaagtcagtgtaatagcatcattatacattactcttgttacctattaagtgctcaagaaaaccataaataccttgctttatagacttgatgaggcagaaaaacctttcctgtgggtcatcaaattaagatgcagtatgactttacgatttgttccatcttagaatttggctgtgttctatctttctgatttcccagagccgtccacttcaggatgtttgggcttctgccagtggccgtggcacagatgcttttaataaagggatccaaccaccttctggaaaacctccctgcttcactagaactttcaagagatatcaatcctgttttattagtgtttatttaaaaagaagaagaagagaaagaagctgaagtagccaacacgatctatgtagtctactttatgtcccttcttttgtcacacaaaatagaatatttctcttgaaaaaggctcatacaattccgtagctatatactgagtgcctactgtgtggcaaactctgcactaggcatggagacaccaagaagatgcatgacttgccttagagctattacacagacgcagtattactttgtaaaaatatctgataactaaaattaatctgtaaggtatatagagatctttgtataaatatcacatttcatagaatattaaaaatatgtaaaattgacactaagtgatttgtattatatatgaaatgtttagtatatgattagtaaagcttcataaacaatgggaaactgatgggtcattcaaaaaatggtataggcagaactgactttttagaaaaaagtaggttataccaatctcagataaaacataaaaaagtagatgaatagctgtttgtattaagaacaatataaaatagaaagaaatgaacacatatagtggtcttaccacacagaaggagtttcaaggtataaaagtcatgaatgagagagcaaatgtcaaacttgacaacataaaaatgtagaaattatacatggaaattttataaaattaaaacacaagtgacaaacttgataatatacttgtaaaatatgacaatgaattaatatcctttataatcaaagaaactgtatgaaacaattactattaccaaccagttgttaccaagagtagaaaaataacaactgagatggttagcagtacacagtaaaagaaattcagagaaatgatggacacaaacatatattaaacttcactagtaatctaagaaatctaatgaaagcaataataaatacattcttgcttatcaagttgacaaatttttttaaatgtaaaaacaattagtgataggaaggtgcacaggcaatctcattcaattccggccaaaatttgaataaattttctagacctgtgttttacagaaagtatttagaaaaaaactaaagttattattctttcattcaataattcttattccagaaaaatttcctaacctaaaaaacatgtaaaaatacattcatcacaatgctccttatgacctaaaaaattggaaacaatttaattgttctgatgtagagaaatagatatagtctatccaaaggatattgtaccatatggtagagctttgagggtggccccacattctgctccctctagattctctctgttccagctccatcctagcttcctcaatttccccagaatgccataacctgccctgtgtataggtgagcagtctgagagcctgaaaagcaaggtgacgtgtccgaagtcataccatctacttggtgtatctgaaaccaaactcaggtcttctggtagcaggaccagaaattgttctaccacataatgcttgcttagaacagtgaatttcaaactctgagtagtggaatctctctctctctctttttttttttttttttttttttttgtgggatgtcacctctaagtatttttgtttttctttttttttttttgagtggcagaatcttatgcacaatttccaataaatgaaagagatcaaagtattatagtactatatagtttttaatgtaaaagtatatttacttacaaagtcaatcagtgagtaacataggaaaatacaaggaaaatttattaagtgtttgtcatatagtagaagtggttaggttgagtgggtaggttggtttttaaaataccaacaacaaaaaaagatgctgttctaaaaacacaaacatttgaaggctgggtgatggatatagttttatatcaacgtcagcacacactgtatttctatatttgggtgtttttttttttttttgtaaaatggggaaaatcttgtttcatatgaataagtagctgaaaatgatgaacatttttaatagtttatatgccaacctgtctcaagatattattcaattaaactgaaacagaagctgaaagaaaagaagtagaaaatttaatatttaaaaaataaatcattaaaaatacccaacaaacattatgttccctaactgccaagggttcaacttggaaagagtcagtaacagggtcctcaggcagtttagatcttgagtgaacactggggaatgttataacattataagatgttcaacttgtcagttgaaatccctcacattatccaaaaagggcatacctcactctctatctcagctagatagtcactttagctttcagtcaaatttatttcattgctgacacattatttaaaattttaagtttgactacaatgtgatcttacattgcaaaactgagcttcttctgtttactacaaaaaatcagcaagacatgcaaactagtgaaatcagttttttgagaactatttcactagatgaaattcagtgaaaacgaatttttgccagtaccttgccacaaaacacccaagggacttcagcatgaaaaaaaaattctgaaatgaatactgcgcatattgtttaaataattcttaaaagacaacaaaaaagcaaaagccctggttgaataacatttacaattagaatgatcttaacgccttgcttgaaagatcttaacagcttatgctctcctatgccacccaaatagcttttcaaaaatagtgtttctgaaaggcactagcctgactattttttccctgatattcattttacacaaactacataattttttttaaaaaatgttttgcccttttgttcgtttgtgtgttgaaaattgtaggtgagaagcagtggatttccctcacccatcgctaggttcatggctgaggccactataatagaagacagattaacaaaagaaaagaatataaattggttatataagttttacatgacactgtagacttctttaggaaatgaagcctgaataatgaggcatgcttctgttttttcttttttttgggggggggggggggaggggggatggagtttcactctgtcgcccaggctgcagtgcagtggcgcaatctcggctcactgcaagctccgcctcctgggttcacgccattctcctgcctcagcctcccgagcagctgggactacaggcacccgccaccacgcccagctaatttttttgtatttttggtagagacagggtttcaccgtgttagccaggatggtctcaatctcctgacctcgtgatctgcccaccttggcctcccaaagtgctgggattacaggcgtgagccaccatgcccggcaaacctctgtattttttatgaaaggcttgaggaagagtgggcggtcacaaggaaatatgattagaggacaaagggtgtggtctaatggtactgaactgcgggtggggggggcttagcaaaacctgtgtgttcacattcttcttggtatctctgtgtctttggctcctataccccgggtatagggagagcacttttcaaagagggtcatatgacctgcttccggtgaagatcagaaaatccctcctaggttttatgacctccttcaggagagaagagcaggggtagagggtggtggtcagaaaggccttcctgtttctactgctttctcaaatgtcacgatgtaccacattttggggtggcatgtcctgaaccccatccaaaccaatctaacgacttctactgtgcggcaagtgcttaataaattttccttatcttttcctgcataaacctactgaacaaagaagaaaaatcagcagtagtgatactctcaaaatgttgactcataaagattccgcataatctttatgaattctttgaattaatgtagctgcttgaattaatgaagtatgttgaattcatgttcttattaaatattcttaggttatagcaccataattctaattgtttcttcaatagcagcctattcatctaacatacttgttagcatatagtttaatgagctttttctggagaaaatgcgtttcttcttcacaaacaatacattttgtcattgcttccatttttttctgtaacatgtatgctaaattaatctgataaccttatttttatgctccctatgctttgttttaaaatcatttaactttatgtctgggttctctattctgtcccattggtctatgtgtctgtttttgtaccagtaccatgttgattggttactgtagccttgtagtatagtttgaagttcaggtagtgtgaggcctccagctttgttctttttttcttaggattacttgggtgactcaggctcttttttgcttctctatgacttttagaatagtttcttttaattctatgaaaaatgatgttggtagtttgataggaatagcattgaatctataaactctttgggcagtatggccattttaatgatattgattcttcctgtccgtgggtatggaatgtttttccatttgtttgtctcttctctgatttctttcggaagcattttataattctcattgaagagatttttcaccttcttagttagctatattcctaggaattttattctttttgtggctattgtaaatgataatacctgaaactataaaaactgtagaagaacacctagaaaataccattctggcattacattggcctcagcaaagaatttatgactaagtccccaaaagcaatgacaacaaaagcaaaaattgacaggtgggacctaattaaactaaagagtttttgcacagcaaaataaactatgaacagagtaaactaacaacctacaaaatgggagaatatattcccaaattatgcacccaacaaaggtctagtacccagaatctgtaaggaacttaaacaacaaacaagaaaccaataatcccattaaaaattgggcatcagtcatgagcagacacttctcaaaagaagacatacatgcagccagcaaatatatgaaaaaatgctcatcatcagtaatcattagagaaatgcaaatcaaaatcaccatgagataccatctcacaccagtcagaatgcccattgttattaaaaagttaaaaaaacaacagatgttggcaaggttgcagagaaaagagagcacttacacactgctggtgggaatgtaaattagtttagctactgtggaaagcaatgtgacagttcttcaaagagctaaaagcagaactaccatttgacccagcaatctcactactgggtatctacacaaaggaaaataaatctttctaccaaaaaggcacatacactcatatgttcattgcaacactattcacaatagcaaagatacagaatcaacctagatgtccatcaatggcagactgaataaagaaaatgtgattatatatatatatatatatttatttatatatatatttatttatatatatatatttatttatatatatatatttatatatatatatttatttatatatatacacacacacacacatacacacacacacccctatatatacatatatacacacacatacacatacatacatatacaccatggaatactacttagccataaaaaggggcaaaatcatgtcctttacagtaacatgaacaaagctaaaggccattatcctaagtgaactaacacagaaacagaaaaccaaataccacatgttctcaattataagtgggagctaaacatttaatatgcatggacacaaagatgggaacaataataaacagtggggactgcttgaagtgggagggtgggagaggcagtgtgggttgaaaaacaacctatcaggtactatgctcactacctgggtaacaggatcattagtacaccaaacctcagcatcatgcaaattacccatgtaacaaacctgcacgtgtaccctctgaacctaaaataaataacagaaagtatagacctactatgcaaaattttcacagcctaaaatacagtaagaactgggttatttttatacctaataacactcaatgcaattaccaagtgctatgtggaaggcccttctgcatgctacttttgttttgcacagtgttggtgtggtaaataacggtgaaagaatccagtatatcaagtcattgtttttgttcaatacatggtaaaattttctttccaagttttcagttttaaaagtgacttgtttctaatttcagagtcttgttacatcatattttttttttacaaaaatgattcaagaatacttaaaacttacaatgagcgtacgggacatgcaaaataaaacaaacaagcgcttattatttcctgtaagagttttatctataactatgctgtctaaacatggtatggagcacttgaaatgtagcttgttagaattgagttttgctataagtataaaatatactgcagatttcaaagacttagtccaaaaaagtaaaatacttcatttttaaattaatgctaaaatgataatatcttagatatcttaggttacatgaaatatgttactaaattaacttcactggggttgtttgttttagttttttcctgttttcttttcctttttataatgcagctactagaaaacttaaaagtacatatgtgacttgctttatatttctaatggacaacactgaaaagaagttagaggccttccctgatttgatactaggaaattccatctgtgtgattgatgcctcaacagatggtgctacgagggcgtttagaagaggcatttgacagaacagtggaggttcatgaaggcctccaggaggaccaggtgataccagagctgtaacctgaagggcagataaggggaagctcctaagagaagtgcaggggctcagaggtaaggaggaataatgggcactagaaagtagctcggtaaacctagagcagtgtgtgactagggagcaagagccagagctgaaggccttgtgtgccagactaggaattctgggttattttgagggaaaagagtagtcaggtgtattagtctgttttcacactgctgataaagacatacccgagactgggcaaattacaaaagaaagaggtttaatgacttacaattccatatggctggggaggcctcacaatcatggtagaaggcaagaaggagcaagtcacctcttacatggatggcagcaggcaaagagagagcttgtgtggggaaactctgccttataaagccatcagatctcatgagacttactatcatgagaacagcacaggaaagacctggccccatgattcagttatctcccactgggtccttcccacaacagaagggaattatgggagctacaaaatgagatttgggtggggacacagagccaaactatatcaccatggaaggttgtggagcagggatgtgactgactcaggcagtagtagatcactctggctgctatgtgacaattagaatggagtgaggcaatactaggaaaagagggtccctggggcagctgtgcagaaatctaagcataggatgagaatgcagtgaggactgagggcccatggtagaataaggaaagccaaatggatttgagaagtagaagtaaaaggactcggcaatgcattcagttgtttggagtttggagggaagtggaggaggcaggcaatgagagaaaggattaaatcaagtgagaccctaggatgctgggttgtgcagctgagctggaaaataagaataatcaacaatgctataaaaattattttcgagatattcagcttccgtatatcttaatggtacatgggtgaccaagactacaatatactttcatgatttgccataagatttctgaggctacttggagttctatgtgtcattgaaagtttgcataatagttcatttttcaaaagtatcttttgccagagccctttgactttattattctgataatcaaaatagtttccttatgaagaagtattcttgccaactaacctaaccacatatttgaaacatcagatgttaataggttggctgatattttatcttttgtgaaatttgccttaccttaaaggttttccactttaaaggtcacaaaagaggtttgctttcctttttagaaagtaaaaaccacatacaggttcaaattcgaagataaagactagtaatgatttcctataactaacacatatgcccaatgagtagttaaagatactcaagaccagatcttgattttaaacctttacatgaatccattccataattttactcctttattcctcaatttcacctaagtgatctctgtaaaataatattctttgattatccaatgcgagtgatagcacatgaattatgtatgatctgtttgtatagatgacattgagaatgttatttaataacaagatcatgtttttgaaaataaaaattacccttgggatttagatgcagaaatgtttcactaacaaagggctctgaaagaatgttggcatcagttaaagtgaaggtatgaatggtggcaggccaagaaaacaactgaatattagtttcttgattccaaaggtttaatattttcatttataataaatgagtaacaatgataaaaattttttcccagaaataaaaacaatggaatatattatgggaagtgttacaagggaatgtctcctctcttaacaacttgaaaataaatgagagatttttcaacatgaagaacataattccacaatgatagcacggtgcacaatacatcattttttggaacattttgaggctttaagactttaggtttaatacccttggcaatatacatgtgtgtacatgtgtatggggaatggtaatctgtgtacaaacatgcacacaaacagaaatgtacattgaactaaaaatctttgtacaatgaggtggcgggagtggggagcaagatttttaaaacttttttgttaccgcgcacacacacacgcgcgcgcacacacacacacacacacacacacacacataggtatatacactattccaaaagcagagccgaatatattaatataaataaagtagacctggattcaggccctaaggacctcgtggcttaatagacaaagaaaaaaatgtaaagtagaaagtggcttaaaaaatttataggaaattcaggaaagaagaatgttaacttaggctcaaaaacaatcaggaaagtgtcataaaagattgccatttcagatataaaaaaatagaaagaatgaatcagccctactatttgatagcacaacagggtgactataatcaataattactcaactatacatttttaaataacttaaagagtgtaattggattgtttgcaactcaatagataaatgcttgaggggatgaatacccctttctcatgatgtgcttatttcacatggcatgccggtatccaaacatttcatacaccccatagatgtatacacctactatttacccacacaaattaaaaataagtttaaaaaaaaatcaccatttcagctagaccttgaataataggaataatctgaacatatggagaaggggaggcaaacattgaagttttaaaaaatggagaaagagatagataaatatatagatgcacacattcatgaaatcgtactattgagccaggagctttcctgatcatatctaaccccaggacaacctgtgaggcagaaagttttcttcacattccagaaacaaggaagcaggttcagaaagtctcctatggtcaccggactgggaagtgccatgcaggagctgttggatccaaagcccacgttctctggctccacttgtttacacttgcttaatgatttggagacatgagcttgtaggacaaagggaagagcaaagcttccctttgattggagagcaagatagcacaatatccaaagtggaaagtcaggtttttccttcttcatctgttttacctgacgagggccagaatttaagggtctattagtcatagatggcatggagtatgcactccctgtgttctgggcgctgtgctgaaaaccttctgtgtgttatctcatttgatctcttaggggctctgtctccatggtttttggtgaaagcacagagggttagaataaggtcatttccaaggtcaaagagctaggatacagtggagttgggattcaaactcactgttactagactccacacaagaacctggggtcctaatcactaaacatagtgcactacaaagcacagttatgtaacatatgtcatatgtatctgtgtataaatatgcatgtatacatatatatgtgtttactttgtgtgtacacacacatacctgcacaagatacaccccttaaaaatttcatacctatcagtgatctccaagtatgcttgtgttgacatgtttgagtttaatacaatttgtttaactagtgatcatgttacttggtgatattttcttcatttggccatgaattaaagagcatttactgggcacctgctttaagccaaacattctgtagacagcaggattcaaagctaagatataactcttgcccttaaataagctggtaggtttaataaaattggtctatatgtgttgcattattttgaaagttatttgctattattgtgttcaatttattttttggtttgctaagaatacatagagataacagttataaattacaaggttaaaaaattcgaataagcaaaaatctcctagtttgctaactatcagttaaatgataatcattgttaaatgatgaatatgtcatattgcaatgtcagtttcacaggcagatttactaggaagctaatgaagtatgatcttcaagatttctcaatttcattgacacattctaagactccattcttatttttgtgaccattcatttgtattccttttcttaagagtcctccctttatattttataaattttaggatctaagaggaccaaatatgcccctggtcagtctttaataatttaaaggcaacccaatgatttgggattgatttcacagtccacaaaaaataaagaactatttctttcctatacctctgttggtactcacctctatttggtatttgcattttagttactccaatagatacccatactagagcgtaagtactaataaaaattaaaactcatgtcaatgattatctctccttataaagaagcctacagagggtcttgaagcaataaagtaatttgaatgaaaactacaaaccatgaataacatgacacctactacttcaaataatccccaagtgacctttatataatttttcttcttggacatttgaaacactttggtagtttaactccttaaccctgtactaatgagatagaatataggtattccctccatttacaggatacgtactctgaccaaggagatttaaaacaaattttatttatttatttaattttggtaatatttgtcagtgaaaaaagctgctgtttaaaatatatatatattcgggcccagtgcagtggctcacgcctgtaatcccagcactttgggaggccaaggcaggcggatcacctgaggtcaggagttcgagaccagtctggccaacgtggtgaaactctgtctctactaaaaaaaatacaaatattagctgggcatggtggtgggtgcctgtaataccagctacttgggaggctgaggcaggagaattgcttgaacccaggaggtggaggttgcagttagctgagattgcaccattgcactccagcctggagacaagagtgaaactctgtctcaaaaaaaaaaatatatatatatatattttttaaatatatatatatatttattatatatatattttaaatatatatatttattatatatatatttaataaataaatatatatatttatttaaataaatatatataaaaatatatataaatatttatttaaatatatatttaaatatatataaatatttatttaaatatatatttaaatatataatatatatttatatataatatatatatttctctatatattttatatagagatgaagtatatatttatatataaataaatatataatatatatttctctatatattttatatagagatgaagtatatatttatatataaataaatatataatatatatttctctatatattttatatagagagagatgaagtatatatttatatataaataaatatatgagacagagaattttatatatatatatttatttatatatatatatatatatatatatattttcatgattcttgctctccaggaaaaacatctttcaaaaacattgaaagatatttcaacactgaaagaatggagaaatctttgccttcaggtttgactccacctaaagcatctgtaatagattcactgcatggcctcagatgctaacttcttagtggagtaatggcatcaaaacttgtaatctgaactaatttaagtataactttattcacatattcttctctttaaggattttcatctcacggattttaattgcagtaataaatggattcagtgtatttttgccccagattatgtactcattctttcagctaagcaatatttattgagaatctatgatgtgatggatattgatcctagtgctggaagcagcaatgaatgaactatacagaaagcctctaccttcaggaagtgagggagaaccttgaagaggtgtctttcaaatattgatcttgccaaagtctgttgtggagtttagtaaactgtaccaaagcagtgtatgactgttagcaaaatacacataatttcattttcacttgcagcttataaaacctgtcagtcatttctccaaaatattggattttctagctctagcttgggatttccattgattgccagtagaatttaaggaaatttcctttctgaggccaaatgcatgtctcagcgctgtccatgtggaaatggtcaatacaatttgaccagtaatagttttttgattgtctatgggaacatctggatctttgacctcacaagtagttaaacaacatgcccttctccctatgcaaaagtgtttgttcgtttgtggctcagaggctctgcgtttgcatgttgggcttcatgttctggaagtcattttctctagcagtgaggttatttaattccaaggactggtttgaatttctttttaaactacaagtgtataggattacatttaattgttggtttatgtacaggagcattgctacactgagctgcaaggagcacattataaagtactcgtttgtcctgagtaaatattcattcagttacaggctggatgagagcccatgcatctctgaatcatgatgtctggagatctggacatcagataggcaaatatctggagatattgctgatattatctattaaccttttgctatctgtagggtcttataaagtagcttgacaattgcagtgtaaatcaggaaaacgaatgcctaaagcttggacacatcgaccagatggctggagtttaacaagtgtgagtacatatttgttggcaacacacagtcagacaaaaaggcgcttgtcctggcagctcacagtgtcgtctgtccaggggcggcagcaacacagactgaggccttgctgcacattgtatcaggctcaggggcaggaacatagggtccttttctgggtcaaatctccctctgaaggtgagagtcaagtcaaggaatgattttcttgaagtgcagcatgctcttccagcagtttctgagagggagatgtccctaaaagggtgaagagagggcatttgttccaggaccctggttcctccaccttccaggatccagaggcctgactgttcatcaccactttcagtgcattctcaacgctcactctctgcatgattcagaaggccacattcttcataatacagtcatgctagacttggaattttgacaagccatgttctcatttctgtgatctatgcttcataaagaccatatggagtatactaaatctaaagaaatctatctgattgtgaacacactgtgtgagacactactaagaagggagtcagagtgaggagggcctctggtggcattttccaacttggctgattgacacaactaaaagtgttagacataattgggagtatgtcattagacactcactaacaaggtggtaccccacttagcagaaccctttttccacctaagggtcctgttcagtgtggtgaggagcgacattggtcagcaaacgtggctgctgcgtgtggtactcatgttacagaaacttcctaaacccttttgggatctctctattgccttgaacagatggcctgtgagctgcggggccttcttccagatccacggcctgcagcatctaggcttgtgcccaatcactaaatggagtcctgcagggcccttcctgatctggcccctgccaacttccccagccttgcgtctctccactctccagttctcctggttatctgaatcccattcccttctagccattcttcatttccttcatttcctcaattgcctttagagttttgcatcaacagtttctcattcttagagcaaacaccctcccagcttatcttgcacctccaaccttcactgaagacttgtttaatactagtttctctctcccctacttaatcagaatacattattcagaaagttttccacaacccatcaggatgtagccagtttggctgatcacctagaagggacccctttttcccaaatctaggttggttcttcccgcttcctcaatgccaaggataagggcacatcagacagagtcactgcctccatcctgccccaatgacctctgctctgtagacctctggtcctgcaggctaacctctgaaggaccagggctctccatcatgggaggagcaaaatcttcccctcataaaaccccatgatttacatggtagaactgtgctttgtatcttgtacacactaccaccaaatgaccctattctgcttctaccttcttccttccgcaaaaccagatacacagcaggccccattatggttttagggtatataagatggtttctcatatattacatttctgtagaggagtgagcattgttactccctgtactctacaatgagttttgaaaggaaaagtcaactctgactaagatcacacagctgttgaggaataggtttgggatttgaaccccgatatactcagttctttccattatgtccaccaatctgttttcttttcttttttgttctatattgcctcctgttttctccaacacaaagtgtctatggacttcaccttttaaaaatgactgtatataagtgaaatgtgtttggctttagttgtttgccttcacagctatctttttgaaaacaaagtgtggctaggtgtaaacccttgggattctgagacaataagtaaaagatgaaatagcattgcaaacttctgacatttttgaactgtgtatcaagatttgtggcatatgtatttgagtctgctacaggaaaattcccagagcacataccacaattattcccaaagtaccttgaactgagatgcctagtcagttcctataactgggtgcaccagagatcgcactgtactccatgccataagccttcacaggtacaggtttttctaaaatggagcttgtgcagaggctatagtcgttttgcacaatgaaagaggctgtcttcaatgtgcatttcgatgtgtgctatgggaatcaggactaaccacgacccatggagacaatgctgcatgacttggagagtgcaacgtaagacgcaatgactctgagcctgcaccacgccatctgacctcaggatctccctgcagggatacgaggagatcttagccatatagcctttctattgccctctactgtctagggataaaatgacagaaaacacagttctgcattttggaagtttgcttaataactaaaaaaataaaaataaaaattactcttgggctgaaagcaggttttccaagttttggttcataataagtagtttttaaacatttaaaaataggggtatgtaataaaatgctgagagactctctggagaccgctgctgctggcactgctctaatagaaagcatacgccattgagctaacattctgttctttgactgaagaagaaaacaaagctgttaaaagctggtaagctcattttccaatagcaatagcattaatatctttcaagtcactcctaaccatacctaattagaggtttataagggatggctcttctggaagggtcacctcaggttacgtagcccacagatttgctgttgattgttggcaacaatggatttgtgtagattttctgctcagctcgaggtgattatcttttttcttttttttcttttgctggtgtgtctcttattttgactggctgaggttgggctggacgatgaggccctgatttgaaagcagtgccaggttgttgctggagatctgcactgacagattgttgaaaacttattagtctctgacgttttaacagcctgcaatgggatagaaatctgctctttcactggaaaagcttaaaaaggaaaacatgagctcgagctgaaatcagccccagttccaaatctgccgtcctctggcaccggagtgctgagggctgccacagtgtgtagagattgaggcctgactatgccacccacatggtagacaggactctgcataaaatgatgtggccctgggccactgtcacgtaggagaccctgaaaatgtatcttctgggagctggggtgttctcaacactgggtgctaatggcttcagcagtaggagaaatcagcctcactgaggtttcagctgggtggctggggggattcttttggtcatagccattctataagataattcaagaaaaaggactaagaaacacttcagcttggtatcctctttggggtaacttctacctcaaatgggcaaaatgatggcagccggtatcactggtgagagacatctggagccaattaagagctctaatacagagatagctatattgtaattatttgatacaatgctagagtaattcattaagcatcctggttcttcgaaagcaaaccaagcctctccagtccagtccataaagatttttttttaaatcactattgaccccaatttttctccaatcccctctgtgacgaccactttgattaagctctctgctttcacccccagcagttttgctcccatccttggcagctgctttcaagatcttaaccaaggttctggactttgcccagacagctacctatgcctagaggagtcctctcttttaccagataactctttcctatgctccagactcaggcctgcggtcatgtctttcaaagccttctccagtaaccccagtcaggggtgggtacccagcattgaaagtgcccatagccttctatgttctgacttcagagtaggctacaaacttcttaaggaaaagacctggcctgaatctcatttcattttgtatccacactcatgatacactgttagcacagagtaggcactcagtaatgtcttgctgactgttcacttattcattcactcacttgatagacattaatggagatccaaacttccaggcactgtcagggagttcagtttcttaacaggagatatctttttatgctctacagacctaaactactttctctccaggcctatcttctagggatctgtctttgattagtaccattcagttcttggttggggaaaagtgtgagatgagaagtgacccagatgtttggaaatgtcatctcaatgtcaggtttcgcccttcatcagcccattgcagctgcacatcatgcagctgcatctatggcagtgcttactggtgtatatgcagaaatgtcctggaaaaataatctcttctcatgctaccccagaaaacttcagaatagcccacagaattacggtaaggaattattcattcattcatttaattaacattgggagcgcccattatgcattagtcattgtcctagacatttagggattcagtggtaagcaaataaaatagatgcaatcccaatagatatatcagcatacaggcatttgccttgtttacctaaaacctcatttgggaaattcatgtattatatggcaaacttgcagattcgaagtaaatagaaaggaagtgagggtgggggtgaaagcagcctgtgcttaagctatgcctactccagattccctttgccactcttgggacggacaagatgtactttactttccactaaacttcaaaaacttccccatagactgatcatggttagcactttttcagctcaagaaacttaggtttgattttttttttccccaaaaaatgactctagtcatatgtcaggggttctttttgttctggttgattttgttttaacatgctatctagcacagtcatggagtgggtgagtttttctgcatttctgcaatagcattcagtgtttagttcccagcttcatgggtatcaagaggcaattgcaccaataaatttctaaaccctggatcactgccacagtgctgtgttcttgaagtcaacaactcagtgatgcttcctagttttccactttcccaattgtggcccactggcctagtaaactcccagcttggtgagtcaatttcacagtgtggttttgagtgtcatttctggaggtctagcctatagcctaatcctccaataatttcataaacatctaattccctttattaaattcctttctgctaaaaaacaattataaatgtgagaagaaaataataaccatagcctattaatttctttctgataacatttaacattacctacttgcagaaaactgttatcttctcagctgacactcaggcaaacctccaagcatcaaggatttctgtctttggttttatttgtttgctaatgtttccactgttctgaagatatcaagacacattctctaaaaagattagttgctggaggtctgctgagagaataataaattcaagttatagtaactactcaggaaaataaaaagatatatgaaagcttatctgaagcagaaaaaacattaactggtttaagaaagctggaagtgctgtcgattgaacaatgagaacaaaaacgtgagcttttcactgtttttaataactcctattgaatgtgatgtgggactattatcagtattttaatattgtcaattggatataatttttctttaaggaaaagaggttcatttaatacttaagggtgattttaaaaatgactcctaacatcaatttttttataactaaacgtatggtgaaagtgatgataaaattcagtttacttaagagaaatatattttgtgcacattttgctagaacatattatttagttcatggaaattatattattttaatttaaaaattgtcttaatgtaaggataggtgcagtaatttttattatgtttaaatggcaaattaaaattatatatatctattgtgtacagcatgatgctttgagatatgtgtacattgtggaatggctaaatcaagctaatcaacatatgccttacctcacatacttaatgttttgtggtgagaatacctaaaatctactctcttagcaatttgcaaatatacaatacattgtcattactatagttgccgtgttgtacaatagatttcctgaacttatccctcctgtgtaaaattttgtaatattttaccaatatttcttcaatttcaccctctaacctcacaacatcccaagctcctggtaaatattgttctaccctctgcttctacaaattcaatttttttgaattcaacatagaagtgagatcatacagtatttgtctttctgtacctggcttatttcatttaacataatgtcctccagattcatccatcttatcacaaaagacaggatttccttcttttttcaagagttaataatattccattgtgtgtgtgtgtgtatctatatcacattttctttagccattcaactgttgatgaacactcagttggccccacgccttggctattgtgaataatagatgcagtattttatagcattcatctttcccttcctgaataaaagtccaattttagatttaatgtggaaaattcttaataaattagcaaccaacttgtgaaatgttgtgacttttaaaattagaagaatttcttcattttcaatcctaaaaactaatatgggaattaaaatagaattttactggatcagttaaatttgttaatttttatttttgttttacaatcttatcgacaataatttaaatcagtacattcttgtgcataatgaagtaaaaactaagcttccaatgatactgtgatgtagattatattaccctgttttacagataagaaggcagatttgcaaaactaaatgcccatgatagtacagtgataagaagaggcagcgacaggatttgaattttgatcagtctgatccaaagcccgtgctctactagatggcaattcttgcaaacagccagtggttagtgggtgagagaaggggataaaagtaaagatagtctatttggccaaggcaatgagcaggtcaaaagtagccaatattcgagaatctatatatctcagtcaaacatccagtaagctgtcaacatttattctatccatcattggagaagagtattccatagtgagtggtactgcctgtgcctcaattttctactctgctaaaagagtacaatgcgagtgtgaaaagtagaggcacagcacttagtacaaggcttagcccataatgtgggcacaaatgttagcaagtccacagatatttagtctacctaatccacaaagatttatgaaggccctggtatgaacaaggcagcaggattacaataatgaggcatgttaggaacactaacaatggacatagtttgactctttatggtctctgagggcaacaatggacattacacacatgaattcatatcctctgtgctgtggaaggagatcatgtgccagcaggatccctctgttgctagcagagatccagccccttggatgagttcttcaataactatgccctattatctgaaggcagtgttggctgggagagatgggcacaaacaaggcaagttggtctcgatatttcaggcacagaagacaagacaaagatagaatccctaaggagagattggatcctgagaattaggcagaatcctggtgagcagcaccaggtacaaagtcagggtcacctggcagcagggtgcttgcatggggactcccagcaagcttgactagagcatagaaggaggagggttgcagcacccgataatccagcagggcacaagacgttcccccaggacagatcctgcagttttctgaaacgtagaccctgtggcttagcccagttaatctcgtaaactgggtcatcaccctgggttgcacagcaagcaggagcctggcagcgaaggctggataaacactggcatcaacaggaaaaagcactagaaagaaactggtttttttcaagccctgagaacaatcagattccctcaggtattgctttcaaatctgttaccatcatcaggtaactttacaaaacagggcaattaaagagctagttaaaggcgcctcagcaatttcccagacctccagggaggtgaagacaaggaagaggaccacctcattgtcattggaagggccaccacacctgttcttgctatttggtgatgagcttgtctagccagtgaacccaggcaggccatgactgttaaggaatgcatgcttcacaggagtttcaaaaactcctcctgaatttgtttatggccaagaaagagagcaagaccccagctcctgtgcccatattcacaccaatgtgcctgttgagtggcacatataaggctgcccttgggctatgatagcaaagagaagttatgcaacctcaacccatcaacccctgcccctagaggccctgcaaggaaagtagaaaagctcttccttcacaacacatgtctggactttttccatagcaaatggcaggggagcaccctagggtcctggagttatttccttgtaggactcagaatgtgaattgatagagcttcctagcactttgttttgcctagaagtttagaacatttaggaaacctctgatccttcatttaaaaatattaacactttcactttaatcactttaaacataatcactttaaaatacaggtaatgcagaaaatgcatcccagtaatttgaaaaggtttaatgtcttccaaaacaacgaaataggaacaaatactatgatcagactccatgggtcgttaatcctcacatttgcttctctgacctgacttggtggcatacattggcatccccatgttacttatgaagaaatgaagcatgaagagattaggtgaaatgataaatatgacacgaggtgagcagagtagctgggaagaaagctcaagatctaggatctccattgagaactcaatgctcttttgcacccttaatctgtatccaacctccttcctccatggtccagcctcttgactcacaaaagcagctttctttcttttcatatcactgaaccaactgtccatctccacataatgtaggccatcttaaaaaaaaatggattgatttgaatgtaacagcatcatcctttctcctctcaacttgcccctctttgtaccagaggatgtcataatcaggtgtgaagaacatgaattctcacatccaggaattttttccccttaaatttctttgtcttatataatgtatagttacaacaaagattgatgggaatggaattaaccaagttgtgaactgtaaaagaaagaggaaaatgagtgaatgtagctcatcttcggtctccttaagggcaaaggaaatatgtagtgagaacaagttattgatgaagacagtccagtctgctaccaaatggcctctcaaggaagacaggtgcagagatgtattgtacaaagggccatttttatattcagagttgtgaatatgaggacaattcttatttcaaaatatttgaaatgaaggaaaacattcagagaataatttaagggacacaccattatagaaaaaattgatagccccagtgtgccctccaacatttcatttctcaacatttcttccccctaccctaaatttgatgcttcattattcattgcatgttttttgctttttctataaattaatgtatccataaataatatgtactattttcagatattttcaacttcataaaatatggacaattgtttttggcttaacattatacttttatgttttaaacattatatatgtcttatatgattggcatattatatattttatattatttgaatattccagatttttaatattatgtatttcatatatacatattatatatatatgttttacagtatatgtagctctaattcattttaactgttgtgtagtattccacttatgaataatacttatttgtctgttttgtaccaagacattaaagttgtatatgaaatttctctacttataaatctagaagacaacttgctatgtcatagggtatgaacatttcatctttgctggattttgcaaataattttctaaagcaattgtatcattttatattccatcccgcaatgtgtgagagtatccatttctctacagtcttgaaaacacttgttattgccagacttctaaattttgtgaaattgatgagttgaaaataaacctcattttatctttaatttgcttgcttctgatcacagctacggttaaatatgttttctatgtttattgaccattcagatttttcctcgtctatgaattgcttgctcatgtactttatccatttttctattagatttgttatgttctcactgatttgaaagatttatgtatacattcaagtactaacgctttgtcaatatactcatcatacaactgtggcctgttcttaaataactgattgtatctctgcaggaatttgccttgcacaaaagttttaacaagcaagttaaaactaagatatagataagaaagttgatatttccgtaagtctgtgagttcaggaaaagcattaggaatgccagtttttcattatttatctacttgtttttccttccaagttcagagagataaagtataggccacctagctttatgtttgatagtatctgtgctttgcagagtgggtagtgtagaataatatgggagatgaataaggaccaattttgagaataattagccgcagattattgggcctaatagattgcatatcttccactgaaatagaaactgtttcaaaccaaatgcatctctagtcgtgacttcacatgggagcacatagaatctgctctatgcaggggcataaggcatgcagaaacaatctattccaacttatccctcaaatattttactaccaggcaagtctctgctcatgacataagtccctagactcaggtaaccaatgaaaacaaaagtagaataatgttatggtaatgtcaggtcacatggatatattgtcttgggaatcttgatatgaaatcttaaaataaccttggctatctttctatttcagaggtgtggcgaaatcttgtttgagaaccccgatcagaatgccaaatgtgtttgcatgctgggtaagaaggcttctcattttaaatatattaagcatgttgatgtcatgtggagttatcattctgttgcctttttggctgtctctcattctgttttgaagaggctgataggttcttttgtggttatgcagacagctataacacatttatatgtgtaacacttgatgatgagaaaaggttctgattttcttaattgtcagccagtcaaggaccatgcttctgagtctttcaaaaattttcttggatcatcagcataacatagaattaggtggtttgtattcaggcagctatgatgaaaaggtaagaaccatgttgtaattcctaaaccaaagatggatgataagatagacaagtaaattattaagtccttacatcacagtacaaaacccttacttagaatttctggaagaaatgtatatttgaactactgtaatctgaagtcagcacaactattatcgacacagcatttgtaacaaaataacaacattgtaatgaataatcatttgttcttgtaggatgatatatcatcaatgcctttgacaaactcttttaatatatactgttaggtaatgaagttggtattattttcctcattttataggttagaaacaattatagagaatataagtgatgcacttaacctcaaagtgagaaatggtccaaatcatgatatgaaagtttctaaacagtaaaattttaggtctagtgtttagatcttatttaagccactaaactatgtccaataaagttgcaattcattatagtaatagaagtaaacagtagcatggataaataaaaataatttctaaattttattttcaccaaatttttacctttgtagattctaaccttgaactatattaataagcaaagaaaaaaattattcattttagcattttctatttactctgcccacttcatatattgacagtctagattattggtgaaaagcagacagcaagttaaatagaggcaggcaaagatcttggtaatttataattcaaaataatcatgtaacaaataatcaaaggtggtacacgacttaagaaacaaacaaaaaccagacatcatatttttctagccttctaatctttcttaaattctttactgatttttaaatctctctttgcagttctatgtttttattttaattaagatggtggctatatagtaatacattcattgaaaaatgaacgttttactagaagcacatgaacgaagaatatagcattgcatccatacacccatttcaaatatccaatattccttccccttgaaagtgtgaaatgaaaatgtctccaaagttctaatatttcaggtactagatagatagatagatagatagatagatagatagatagatagatagatagatagacagacagacagacagacagacagacagacaaaacaggtacagatggaagcagaaaaaaaatcctttgttaagccatgtgtcccagttttggatttgggaaactgttttaccatcacatcaaataatctattcaacaattaactcatttaattttccacaataacaagatgaggttggtgctattgttatcttcattttataaataaggaaattgagggaaatggttgaatactgcaggtaccttactaccactgaaatattatttgattgtagctttcacctggtctagtaacttgaatcaatgtttaactcatgataattttaagcacatgaatgcatcatctattttgactgaatgtttctgtgtcctgtcttccatgtaagttgattgattagtttatagctagaacagtaagagactttctactactgcctatagatttgaattcacttaaagtaagatcaattatctttccatctcttctagattatgtggtatggtttatatagctgccagaaaacaatcctgaccgccaaatatgtctctaatgaatctgccagattgcacaaaattctaaaattagaaatgcatttatataaatcagttttatgttgctaccactgtcataataattacagttaattgagcacttaatatgtggcaggtgaaatccatcccaaacaccttacataattagatcatttattctaagtaaattaagagaagctctatctttcaaaatatagatatctctagcaatagaagagttttaattaagctgatactggttattaaccttgtagatttcattagtttgttagatttccctttttttcgtaattcagaactaaataataaaaggaactgtgagaatggaagtttttattagtttcaggacacataggaataacaagtatacattttacctttaagatagacagtaaataattaatgactattcaaagataatattatgcttagtgagtttgagttgctcacatagtgaaaattgtgcccttgaggagcttatatttaagacggcttagattttttaagagaattgctgcaacttttaattcagacacttatgaagtcctttgaaatcttagatggaagaataccaaaataaaatcattatggatatcaatacacatggatcaaccccaccattaacatgcatccacctgaagcccaaggactgccacttcacagcaaaatgatcctagatgataaaagaaagaagtaaagtttaatggtttattcacttaaaataaacaagagaaatcaaattatgagcacgtaagtccctaaaactgagaccacatcttgtatttcttcaagaaagaatatctatattaacacaaaaagcacctcttcaccactgtctaaggtattaattagtttgttgctatcttcaaaaggaatctcagataatgttcttatgatttcctaaagcattttttgagaaaactttacatctcacacaagaaagtataaggagtctctgatattgtaaaggactattgtgttttataagccctgccaaccataaatgtagtttttatttttgtaggtaattttataacatttttatgaataaatcaaaatttctaaatgagaaaaccaaatatatggggccacctcaatattcagatccctgatggggaccaacctgagacatcctcatctttaactggtcaagcccttggctcactcccctggaaacctccctctctacccactcacactccaggtttgggtgcctgctggatcctagctgtgtactggtttcagcacagttggggtggaatctggagaagggtcactagccagggactccatttgcatttccttctcttccattggcgagtccccatatcattctgaaaagtactgtttttatgctttgtgttgtctacctcacgacttccatgaatatgccattcttatggaaaattacacttctgactcattccgttaaatgagacataagtgtaaaattcacctcgagttactctggtgcgccggattcaatgcagctttaaatggaaccaaactactgtcatgtatgagtcttgcagggaattatttctggcttcaagagaatagctcatgttggatatgaaggtaaatacaggtgtactgcagagctgactacacggagtgttaactatttattccttacaattgttcagagagagcaaatgtggatgatcaagttaaacaccaaattgtaatatatgttgctttcttttttccttcaggcttagggaaatgtgtgtagagcttctgcctccctgtcctcccctctccaccttcctttttataaatttagccataagatttcactcaagttcaaattggcctcagaagtttatataattatatcaatggatatacaactgtatagcaacacttttaccttcttcaggtctcatgaacagatactaaaagaaagaggaagtggaagagacattatctctcactgtataattaatgcatgaagtatggcaagttacaaaacagagtttacttttcaaaagcataatgaaaactgttgggcaaaaagagcccagaatatttaaagaaattatgtaaaatgatcaatgttgattcacttctcagttcatttgtgaaccttgctctgtgaaacgataaatcatgggaaaagaaactttcaagaagaaattgctgatcagatttagtgcttctttgtatctcctatttttcttattattagaatgggattttttcaaattataagccttaatttttaatttatgatattttgttggctcaatttctccatcctctttatcaaggtttaatttttttaatttgaaattttcattggccctgtttttgtctcatgtatgatttctttcatgctgatgagtatcatgactattagaatgtacaataagcactttcttacctgccataacttagaagggagtattcatattagtcagttttctggttgaaaattattataaatgatttaaatgattgctaatcttcagaacaacagaacaccagaaaatcaatattttattaacactcaacataggcatagagggacttgctttgtagcactagctctgaaaaaattaactgtgtactcacagaagttgcttcatctctctaggattcaattcatagttttcctgcaaagtggaaataaaaacatctgtccttcctagcccaggggtttttctggtgagagaatgagatgttctatgaggagaagcctgttatgatgtctgccctaaatattgtgtatgcatcaataagttgatgcataaatgataaataattgaaaatgtaaaaattgataataagcaaatataaataagctaataaaaattattactgatgataccaatggtgtttagaaaagcaatcgaaaagctaaaacatatgaatataaggacaattttttaaatattaaatacattcttcaaaattgcatggtgcctccagggtagaacgagaccttcatctaattttaattaatcggatgtgcatcaagcacctacaaggtcgtgtgcttagcattgagaatccaaagaccagtggggcatagagtctgcccttagagggtttattgttcagcaagagattgaggtcctgaagcccaatgtatgcaacaccaactcgactgataaaggctacagaagaaataaagataaactacactggacttcaaaacatggatagagtgcatatagcagggatgtgaagactcatctatctagatatgaaagttgagaacgtggcagcactctagatggatgcaagaccactctcaaaagctcagagataaactggggagtgtttctggggcagtgtttcaggccacgaggtagatgaaagaataaattgaaaagaaacttgagacctgattacagagagctttactgtcatcattggccctaaaaaggacagaagtaccagataaaagagagttctggtctcttttatttagttagagagtcttttcgatttagttatagcatatcagagaatactctataagctcctaggtactgggtagtattaagtacagccattcatcagctacttgtgaaattaaataattttaaaccaatgcatatttaacccaatgcgtatctgacgacctgaattctggtttgattttttttaaaaacatgttaattctatttttcctcttcatatcaaatattatagtattttattaagcaacaagataatattttcatctgtgacagtagagaaaaatgtttttttcacttttttggaactttgtcagctaataaagttgggagttattttatatctatattttgctcttatcacttgcttcagcttttggtttttgcatgtggacacttatgagacctatatactgtttcttaaaaaaataatacacaatctgttttaaggcaaaataagatttggtatcaaagtaggccactgtggtgttggtagaaagaacagggcattgaaagacctggtaccagctaataactgtgtgagcagaggcatgtcatttaggggttgtagacctgtttactcttctctaaaactgaataataagcaataataacaatattattgtctaccttattagggctgttgaggattacgtgacaataaatattaaaacattcagtgaacttttagaagtactataaatataagttattatttttattaatactcaattttttctaagtccttgcacttcattttatattagtagtatttttatagcaaactgacagtattgtagattttaaatattaaatgatctcaatttggttcaagtgaatagatattttcaagtgcatgttggcaatttagtaatgaacatccttataggttatgaaagaaatattattgtaaagattattttgcgtgcacttgacttaacaagtaaagactgtgttgaaagacagacgttttcaagttgctcgattttgatttattaaggttagaatgcctcaggaatttgaattaattttaacttacactttcaaagctcttcattgctgtcacttggattcatcaattcactctctctatatgcgtgctcagacaacaaaattgctgaatgatattttcttactctgcccaaagagggtaaattgaacctggatattctcaagggaggatggtggaagcatcattccccatcactcacccaaggccctgtcttgtttcacttttcattgcacttatcactaaaggacatattttctatttgtccatcgctgttccccagccttgccctgcaacacacccatacacgcagaatgtgattatcacagaagtaaggactccgtttcattcactgttgagtatccagcatctggaacatctagctgcccagcccctaagaggaactcactatttgctgaatggatacgtgctgatgtgtttgtgagaacagcagtcatccggagtgcatctctcgagtgtgtcaaagatcggttggcctagtatttaaaactctctgctaacatagccaaggccaagggtcagctcctacattaactaactggtggcttcccaagcacactactccaggttacaagataagaaaaagtggttcccttcaaataggcaatgaggaactatcctaagaggaagattaacatgcattcattgagcactgctgtatgcccaaccctctgctaggagtactctgaaagttgatataataatgagcaaggtagaatccctattgccacagagtatattcttgggcagatggagcattgtgctgagaatacaggaagaggcccattattttgtcttctgtttatgggaatatacagaaaattttttcaccttgagggttatggtttaaaaggcattccacattatcctactgccttttaaaattttggaagtcaatattgctttgtgtaagaaaaacaagtttcctagcttgaaggttgctttctgtggaaggttgcagcatttccacagcaacagaacacctcatttttgaatgcagctggaagccagggctcagatgagagctacctgcagaataacaacacaagcgaagtccaaactatcagaactgaagttgtcaagcccaaaagtgatagaagtgtcagtcttgtattgagttagcttcattttctgtctaaagctagaaaaagggaattcaatgagacctatcagccttacacaaagctacacttcagaaaacatgttcaatcaacaaacacttcatagatacacattgtgtgccagagtagggatgcaaagatattgaaattctatcctcagcaagctcccaatctagtgacacagggacgaccacacaaacaatgacaacatagcatgataaaccacaatcaggagagcccaggtcttacgggaaggggaaggggaagggtggagtggcatcaggaaagaccttgtgcaagacatggtaaggagctgagtgtcaaagagaagctccagacagccctggagcttgcactgaggacagcccattgggaaaggtgttgttggtatttctaagagcaacaggtaccggcagcttaatgtgaccaattaaaaactgtaagaaagtctttatgcctggaaaatagagtaagaggaatgagataagacaatcgaatgtggacaggaaggcaggagagattatgaagagccttataataggacaaataaccattgaaagatgtttaagcagaggagctacaaggggagatacacactttagacagatcatctgtttagagtggagaatgcacaggaggaggatatcgctgaagaaagactagtttagggaacagtggtatctatcaggtgagaaaggatgagtcctacctgaattgagacagtgtcagagagaacagaaggtgcaaaatacaggaaacttttcaagagggtgatagaactctacaatgggttgagtgtatgaagtgttattaaacagatcgagatactgccctgtcccgcaaagaagagtccaagagaattgaatttgcatggggtggggagaagttaaattttagacacagtaaatctgagatgcccaaggaactttccactgcagcacagctcagaaggagggctctgcaagtcagtggcggtggcgacataacagaaatgagatcacccagggaaaggtgaggagtgagatgaggttgtgctttggaatgcccagaagcatccccaaaagggttgggcaggttcaaaaggagcctatggaagcctaactaggtaggagactaaaatagagtgggcagaaagataaaggaaaaggagaggattgtaccttagccatcttagcctaactaggtaggagactaaaatagagtgggcagaaagataaaggaaaaggagagaatggtatcttagccaccttagccaagaggagagagtttcaaaaggtggggcataatacaaatgtaaaatactgtagaggtcaaatgagataaagcctaaaaagtgttgcttggacttagcaacctgaaggtaacaacagcaagagcatcagcagcagaaggtggggtgaggtgggtagtgtggagccaggccacagggagctgagggcactcctctgtcaagaaattggtctgagagggctgagtgcagtggctcatgcctgtaatctcagcactttgggaggccaaggcaggcagatcacttgagcccaagaattcaaaaccagcctgggaaacatagcaagactccatctctacaaaaaatacaaaacttagccttgaggtgatggcaggtgcctatagtctcagctactcaggaggctgaggtgggaagatccattgagcccaggaggtcaaggctgcagtgaaccatgatggcaccactgcacactccagtctgggtgacagagcaagaccctctcaaaaagaaaagaaaagaaagacagaaagagcaagagagaaaggaaagaaagagaaaggaagaaagaaagaaagaagaaaagaaagaaagcaaagaaataaagacggaaggaaggaaggaaaggaaggaaggaacgaaaagaaaagtcagaaaggctggtggaggatatgacagtacctctcaaagtctgccgtcaggaagggtttcttaggataggaaggatttgagaatgttttgatggtgagaggaaagaggagaagaactggctgaagttttatgaagagaaatggagtagttgtgagccttaaacctgcgattgtgagaagatggtccccgtgggcgaggaagcatggagatagagacaggtgtgcctgggtccggccaggcagagctggaagagtttccatctgattgcttcccttctttttaagaaggaaatatggtgttctgatgagcttaaggagaggagcaggtgaatgcaagcatacagaactaggttaattcaaaactaatgttacaagaaatataaaaaaactgaatagaggtgtttaaaaaaatgtggagcagttttgaggacccagctgagttggacactgtaaatatccaggcctattctttaaaattaaaaaatacagaaaagacaaactatgtgttcttaacactcatttcaaaagagtaactgtcccatgctcataaagacccttccctttattctccttaactgcttcccggtcctttccctatggccagccaaggtaatctgcaaggggatgccttgaacccaattcacaaatccctctccctggtattgtacatgtgaagttgcttctccacttccccagtgagcctgcacattccgggtaataggtctctgatttaattttctagcaccctgtgttggcctagaattccaagaaaacacaaaaaataattcctgatgaaggtagacaaaatgtctaaggttatatattcacccctaacattctcccaccacccatggtgactctagaaggttattttttgacctgtcttggcctaaaaggggatgcctctacatccacctcccactttgtgaaggagaccaaaggtgctaagccatttgagctctgggagtacaaatgtcccctgagctgggcccacccctgtccaatcacatcaaaactgcctcttccagccagaacagtggttcacgcctataatcccagcactttgggaggccgaggtgggcggataccctgagctcaggagttcaagaccagcctggccaacatggcaaaaccccatctctactaaaatacaaaaaactagccaggtgtggtggcacgtgcctgtaatcccagctactcaggaggttgagacacgaaaatcacttgagcccaggagacagaggttgcagtgagcctagatcgcgccactgcactccagcctgggtgacagagcaagactctgtctcaataagagttaagaaaactgcctcttcctcatcctctctaattctggttcattttccgcttctataaattggattcaaaacttcttgctttcaagatgagtccatctaggaatctttgtatacatcaaactgtactttttaaaatgttccagagacaatgtcatttttaattttgaccccaaaacaatgttaggctttctattggaaggagtatagattatagttatatttcattgtaaattcatattttttaaacaaattattaatataggtttatgagatctcaacctgccaatctcaaaccacctcataaatatatgaggttttctaatattcataaattataaatattcacaaaatatagaaattttcagaatgagacaaattacgtgtattacaaaggatgcacaagaacaaatgttgaagtattaaataaataaatacttgttctcattatatcaattgctatctttgaactgtagcatttctttttcatatctaattgccaaaatatattttgttttcttaccaggagatccattctaaagaagtagctagctgatggtatagaaagctcagttttcataaacccaacattttcccctctcactgaataatgcatgtttttgtgactctagcatgaacgctatcaagcttactgattatttcttactataaaaaccttaaaggcaaatctaaggatatttacaaatgaaaaccaaatgtgtagaatttttttgcctacttcaaggtacccaaccacataggagcctaatttgatttgtagtcaacattttttacattttctgacttgtaatttaaggagatagttaacatgaaatcttgtacattgccattttagctttacctaaattctgggattctgggagctctagttctttgtgacacaatagaaaaattgaagacatcattctaaacaaggacctgacattctgaaatataagaaaatagtgccagaaatgctaataggatatagaattccatgaagttggtgaatagcaccatcctcattttttcaatgataatcatatactacaaatctgagagtttgggaatatgaatagtaaatataagaaaagagttactatgtcaagctgctttctaaaatttatgtcgaaatgtaaatttcagaaaaaggcattttaatattttctcttcttttagaaaatcaagtatttaaaaaagaaattgaacatcttggaagtatatattgaactcaaaaatacattttccttgtttctgaggaaaaaaattagcatcatattcctgaattactgcattgtttatagaatgggtttgttaataattaattacaccaggcagtctacggaaaggtaccttattttgtctgctatttcactctttgtgtcaggaaaaatcttccctcatgaatcatgtttacaagatggttgactaatgaaatgccaagaggactctgggtaacagtatatgaatgactatgatcatgttttgtataatttaacagacatttggaatatcacagagtcttttcttaaaaaaaaaaagtttacatttttggaggcagagtctcagtttgttacccaggctgaagtgcagtggtgtgatcagagctcgctgcctcctggaattcctgggcttaagcaatcctttcacctgaccctctcaagtacctgggactacaggtgtgcaccaccacccctggctaatttttaaattttttgtacagatggggtttcaccatcttgcccaggttggtctttaactcctgggctcaagtgattctctcaccttgaccttcataacagagtcttaagcaaatctctgaatatctgaaggggcttagttctttcaaatattgctttcatgggactttaaggttgcagttcaagtaagaggtagatgataacttcttctcccagactggtctacttcctaggattctagaattttgacggacaggtctccaacatgtgaccatacaaatttgtgtaaatttctaggacataacaataaataaaggattttttcccttgtagcaactgtaccattgaaaatggagaagtgtttgactaataacaaaacatgtgactgccatgtttattttgtttactttcctatggaaaagtttcttagaagatcagtttcaaatgttagcatctttaagagagaaaattttcaattactgtatttaacattagtaagtatgaaccaacaatgtgcatacacatgtgtaagcttatatttaccagtagcctgatgtgcctcaacaattgaaatggtagtttatatacttactggcacctctaattctcctgctattcatttatttagctattggtttattttgatttaaagtggggtttttaactttttaattgaaatacagcttaaattctgagaaatgtctagtttttaagtgcagctcaatgaatttttacaaagttaacgtatctgtacaaaaccacatggatgaaaacagatagtttccctcgtaccgcctcctagacattacctcccaaagattccattctgatgcactgaattctatcaccattccctaattttgaaatttatatagatgaaattaaagagtatattctttgtccagtctgccttctttcactcaacactgtctatgagattcatgcatgctgttgcatatagatgtagttcattcttatttgtttcttttgctatagaacagaagtcagcaagtcacagctcttgggctaaacctgacctgtcacctgtttgattagaacacagccatgtccattcatttacatattgcctatggcagttttcatgctacaaaatggtagagtttggtcatgatagagaccatctgatccccaatacctaacatatttgctatgtgtcccttcacagaaagagattgccgattaccactatagtgtctaaatattcttatacatgtctttttgtgcaaaaaattacacacattctttcaagtatctacctataattgcaaattgcaattgttgggtcatagagtgtatatgtgtgtgtgtgtgtgtgtgtgtgtatgtgtgtgtgtgtgtgtgtgtgtgtgtgtgtgtagttcagctttattctgccaaaaagttttccaaactggctataccaatttatcctcctaccagctgtgtacaaaagtcccacaaataatttaacactcaatgattaacttaagtaaaagttagaatgcataattcatcatttgactcaataaaaacagtttatgtaatagcctgtaatgaagatcatgattatcatttaagtaaacaaatcatcaggtgttaccatcaggttgatgatggtagtaataaaatgagtaaattttatttgctgattatccatgagcattaaagagttgatgaagtttgttgcataaactgaattaatagttattctttgttgaacacttgaaaataaatgtcccacaaatgatcctagtaagtgcttactcacccacagggaactataaacaaaaccctggttcataaataaaaactgttttctgtcgacctaattaattttcattttttctttctcaacaaaatatacaactaactatattttacagatctaaagttataatatgaaaagttatgattaagggagtgagggctgaataggaggaacacagaagatgtgtatggcagttaaaatattctgtatgatactgtaatggtagatacatttgtctatagaacatgcaacatcaagagtgaactgtgatgtaaactgtggatttgggatgataatgatgtgtcaatgaaggttcatcaattataacaaatggaccactctgatgggggaggttgacaatgggaaagtttgtgatgtgtggtatgtggggtatatgggaaattgctttaccttcctctcaattttgccctaaaaaaaccaaagacttaaaagacttaaaaaataatagttaaggcatcatatttggaaaaatcgatagtttagtcctttactatgaaatcatatagcctaacacttctaaacttaaccttcatgtgttgttttcatggactttatacatacttgctctaggaatgaaacagcagtgttttcaattggccttttttatcagtttctctcagtattgggtatgtgcaggtggggagggtcacctttagctagtatcagaattgagttgaatgcgagaattataaatttcgtataaaaaaattcaagaagcgtttttgctaccaggtggtaaaatcatgcatattttttatttccctttttttgtctctttatattttccaagtgttcaataaaatgtggtcattcatttttctaataaaagagattttaggttatttctctgatttctaagagtacaaagggtgtttcttattgtttgtttgcattactaaaacctacatctcccaagtataaaggttttgataactgactcccatggtggaatatgcataaatagagaggtggttgtgacttcaactgtgccttaaggtaaccactacaccagttgctgcatcttagagttgagtcagggcttttattaaacctctctcacaaagtcacctgaccccaaacaaatggaattcctgagatcagccatccttttgcagagggcatgtgacccaaaaatccagtaccttgtatcatagatcaacatgccacccattgacatccagcccatgacatagcacagaagttgcaaaacaataggaaagtcaagtaactgaggtttgtggttctgcggcaaatggaagccttccagaaccaacacactaagagtctgttgcagtagggatgggtgagagctcattgcacaaatgatatcaagtaatgtggaacaaaacactgtggaactttctgaggttctcaaaatcgaaacatgtaacacagccacactagtacacatgcatgcacgtgcacatatacacatggagacacagcctgcctctgcctcagagacatcctcaagatgttatcaatacatgtttcaattatgccaggggaatttgcagttttcattaagctaagagacaaacaaaaggcaattgcacatttccaagttcaagatctctattttcttcctttcttctcaaattggacccaaaaggcatagttttgtctgagggaataaaggtacagttattttgtgcaaccagttagtttactttcactgttcagagaagaaacggagagaaatgctatataactctgagtgtcctaatgtctgcctcaaatatatgaagatcctgctgatacaaaactctataaagaactacaaatacagtgtgattttccaaagatgaatggttatgtatatgtgcatgtgtgtatagaaccttaagtggtaagaaaaattttaatttgatttgattcgtcgtattttgtcctgcattttacagcttttctaccatcaacatgtattactttcataatagaaaaaataaacatgagaaagaaataacctgttggtaactttttttaaaaaaacatggaaaggaaaggtgattggcaatctcatccttagaacacttccctcctcggggaattctttttatacttgatttgtctttagagtgacttttttctatttttaatgaagggggctacctctgcttctgttttttctctaaaaggggataaaaagaaatgggggaaaaagctgagagcagtgtgcagctgaggtccagtgagctctaaagaggccctgaaaggttgttcagggacagcatcctgttgtagaactttcccgaggacaaagagacaggcaagtctttgttcaggctctatcatctagttcattgttctctcattgaaaaattaaaatgtgttgtgaccacttgtttttaacataaaaagctttttctgggttttttttttcttttattttttttgagacggagtcttgctctgttgcccaagctggagtcagtggtgcaatctcggctcattgcgacctccgccacgagggttcaagtgagtctcctgcctcagcctcctgagtagctgggactacaggtgcacaccaccacacccggctaatttttatattttcagtagagacaggcgtttcaccatattggccaggctggtctcgaactcctgacctcaggtgatctgcctgcctcagcctcctgaagtgctgggattagaggcataagccaccatgcccgtccctctgggttcatttttaaagtaaatcatcatactggagggaaaatcagtggcttcccaaaagtatatagtgtctttaattgtacccataatcattgtgactccaaagagcagtgtcaagtaacagtcatatactaggatttctaatgtacaattataaagtaatgataaggaaaaagttgatttgtataatattttgcttatactctgagcctggataatctagagcgtatataatattctatagctatatgatctgataatgatggatttgtccagtaaaagtagataatgagttccaaccaaataggtgcactcttctaggcaccagaaaaacagtagtgaataaaacagacaaaacttctgtcccaggagcttagattctagtaggatgtgggggtgcagtaaatggacagtaaacagtataaaaaattaaattagatattgcaggctgggtgcagtggcacagtggctcatgcctgtaatcccagcactttgggagcctgaggtgggtggatcacctgagctcaggagtttgagaccagcctggccaacatggcaaaaccccatctctactaaaaatgcaaaattagctgggtgtggtggcgtgcgcctataatcccagctacttgggaggctgaggcaggagaatcacttgaacctgggaggtggaggttgcagtgagctgatattttgcagttgcactccagcctgggcaaaaagagtaaaactccatctcataaataaataaatgaataaatgaataagacattgcattgttttagaacatgatggactataaaataaataaagcagaagtatctgtgagaaatggagtaacagtggtagaggcggaggtgagggtgctgatttgagaaggtgaacaaggatctgcttgttcaggagcagcaggatctgctcaggatctgcagcaactgtcctaggtagaaggcacagcacctgccaaaggcctggagcaggagtgagcctggagaacccaaggaacagaaaggaacaagtgtggctaaagctgagtatgttaatctgttctcaagctgctgataaagacatacccaagactgggtaatttataaagaaaaagaggtttgatgggcccacagttccacatggctggggaggcctcacaatcatggcagaaggcaaaaggcacatcttacatggtagcaggcaagagagaacttgtgcagggaaactcccctttataaaaccatcagatcttatgagacttattcactattatgagaacagcatgggaaccgaacctcatgattcggttacctcccactgggtccctcccatgacacatgggaattgtgggagctacagttcaaaatgagatttgagtgaagacacagccaaaccatatcaccaaggaatgaggattaggagacaagaggtcatgggaggcagaattgaggagtcctcatgaggactgtagatttattctgcatgagatgaggagccagaggaaatttttgaacactagtgtcatggaatctgacttcctttttaaaatactggatatcttaggttgattttgaaaattaacaaaataaggaaaaagtgcctgcagtatattgccattgtccttaaacaagcactgaaaggatatgtttagggtaataacaataaagagatttaaagccatatgttatatatgctccagataagtaatatggtaattaatgttcatctaacatagaaagttcaactagagaacataccactttaaaggagttaggacttagaaaggaaaagtgattggcaatctcgtccttagaaaactcccctccttggggaattcttgccgtacttgatttgtctttagagtggcttttttctagttttaatgaagggggctacctccgcttctgtttttctctctttgactctctacctttcttaaagaatagcttggtatcatagttaatggcttactcaggaaactagttttactaaaaaacaaaggaaagagaagcctctcctttttccatgatctttaaggtaggtgtttacaaatgctagcagagttaagcaggctccagagtctctttatgacagagcagggactctgcattctcagaaagttgtctactgacaacattagtggtgccattgacctaggctagaatgagtagcgctccctagggttgcgatgtggcagccctgggcatgagagattggttcatcacagacatcaggctttggcctctctgatgccctttttgtctgagaaccatggactgacccaaataccctctctttgatttattcagtcagaaagtgagaataccagcatttctctactcccatcccctttaattttacctccaaggaaaaatttgtgtgaatttttaaagaaaggcacatctatacagaatttataaggtaactcggtgaaaaggagacccaaaacacaaaatataattgtccactcagtttggccagcaattattgagcatctactgtaatcctagaactatgcttggtagtaaggataggaagaaatgagtgtggccccatctcccgtgttctgttttctagcattatacagtcagccccctctgctctgcaagagaatgaaacaggactggccctttccctgcagtggcattgttttacaaactcatggatattcaggtacacacatcagcctggaacctgggcctcctctatgagttgtttcatgcttatcctggtcaaagcattgataggcccagaaaagtctataatgggtagattcaattgacagtctggagacttgattttatgtcctggctccttccccagattgtacaccataatctctctctgtctcaaattccccatccttcaaacatgtccaacaacccgctatgtaaccccaactttaactgcattgcttatgagtttgaatgaaataacaatatgagtaaaggacacaggaaaaaaaatcaactgtctatgccaatatcaggcttgtaaagggtatggtcactttctatcaagaaaccttggtagttgagtgaaccacatttttctttagtgtgcctttagtgaaaaatgactaattgaatagaattgctagcaccagaacttcagctttcaaaatactaagctatcgctgtgaaggagacagtcctgaaatctgtgaccttggatcaggcacaacaacctatctgctctcaggcaccaaaagcagacttgccaagcaaatattcctggagtcaatttcctgatgaattctttagggtctatgtccataactgtccttcataagaatgagggatgcttaattttgtaggatactaaatggtttggcttatctgctttctccaaaatacatgctgaaactgtaggaaagctcatggccgaatgaatactcgtataaggagaagactaaagaggtcatgggcaagagcacataatagatatccacaaggggccagcgccacttgggcaggacctgaaggccaaccaagactgtgaatccccaagccaaggtagctgagaacagagaaagtcaatgactcctgtagaagcattctcttcatctctttggaagccttggcaagggtactgtggctattgaagaaaggtttgctttttggcaacactgaaacagatttaaattcatattgaaacaaatgacgcaagcatctctagttaaaatagctttgttgggagaactggctagccatatgcagaaaattcaaactgaaccccttccttataccttatgcaaaaattaactcaagatagattaaagacttaaatgtaaaactgaaaatgataaaaaccctagaagaaagtctaggcaataccattcaggacataggcacgggcaaagatttcatgatgaaaatgtcaaaagcaattgcaacagaagcaaaaattgaccaatgggacctaattaaatgaaagagcttctccacagcaaagaaactatcatcagagtgaacaggcaacctacagaatgagagaaaatttttgcaatctatccatctgacaattctaacatctagaatctacaaggaacttaaacaaatttgcaagaaaaaaaattaagaaagtgggcaaatgacatgaacagacacttctcaaaagaagatatttatgcagccaacaaacaaatgaaaaatagcttgacatcactgatcattatagtaatgcaaatcaaaaccacaatgagctaccatctcagaacagcgattattaaaaagtcaggaaacaacagatgctggtgaggctgtggagaaataggaatgtatttacactgttggtgggaatgtaaattagttcagccattgaggaagacagtgtggtgattcctcaaagacctagaaccagaaataccatatttgacccagcaatcccattactgggtatataaccaaaagaatataaatcattctattataaaaacacatgcacacataaattcattgcagcaccattcacaatagcaaagatgaaatcaacccaaatgtcaatcaatgatagccaggataaagaaaatgtggtacatatacaccatggaatactatgcagccataaaacggaatgagatcatgtcctttgcagggacatggatggagctgggagccattatacccagcaaactaatgcaggaacagaaaaccaaacactgaatgttctcacttataaatggcagctgaacaatgagaatacatggacacatcgaggggaacaacacacattggggcctgtggtggatggtgtggagtgggggtgttgggtggaagggagatcatcaggataaacagctaatgtatgctggacttaatacctaaatgatgggttgataggtgcagcaaaccaccatggtacacgtttacctatgtaacaaacctgcacatcctgcacctgtatcctggaacttaaaataaataaaaatttaaaaaataataaaatagctttgtaatatacatttcacatattaaaatatgcatttttctagggatagctttgaaagaaacttctctataatgaggaatgaatcagagcttgttagcatgaaatcatatttcagggtcttccttggctcattagagagcaaaaggtctcatagatcaagagaaaaaaacaagcaaaggggagaggattccctatttattaatggtgctgggagaactggctagccatatacagaaaactgaaactggaccccttccttacaacttatacaaaaattaactcaaggtgggttaaggacttaaatgtaaatcccaaaactataaaaaccctagaagagaatctaggcaataccattcaggacataggtacaggcaaagatttcatgatgaaaacatcaaaagccaaaattgacaaatgggacctaattaaagagcttctgcacagcaaaagaaactatcatcagcgtctgagtcatttttaatgtactgtataatggaaaaggaccccatggctattcagagatgaaggaaggaaatgagatgataggaaagagaaaataacccaggtggggaaatgatgaagatggtgttgaactagtgaagtgccatgctatagccaacagttgacaagagtgttttactagagaaaatagtgactgagtcagtgcaaaaaaagtgacctttctcatatcaaaaatccagcaatttattgtttctgtaaatatttattgagtatctagtacgtgccagccattcttctttacctgcgtggaaatagcagtgatgaaaataaacaaaatcccttgggtctcataaagtttacacttcattggtagagataaataaagtcaggcaaacacatacttaaatcatttcaggtcgtgatacagactatggagaaaagaaaagcaggataaggggacagggagtgacatggtggtggcaggtgggtagcttttgtggagaggctggtctaagaaggcattccaggcagagagggcaacaggtggaacaagaggaaggccagagtgtggaatgggatgaacaagaggagaagcagtaggaggagatgagttcaaagaccccagtggggcaaaattatgtggggtctaggccagtgcttctgaaactttaacatgcatgcaaatcacctgggcatattgctaaaatgctgattttgattcaggaagtcgaaatggggcctaagattaggtctatttaacaagttcccactgatgctgataatgccagtccccggtatacattgtgaagagccagttcctaatccataatggagagtttagatttcattctattatatgtgcagtgttctgaacaaggagtggcataacttatatttttagagatcacatttgcttttgtatggaaaatagattctacgtgggcactgggaaagaactacgacattcgtcagggctggaaattagtggtttggcctagggagactgtagtggggcagcgagacgtttggatccaggcaatattttgaaggtagagctgataatatttgccaatgaattggaggtagtaaacagaagaaaagagggaagcgtgcatccttggcttaagcaactgaataatggtgatgtcatcagctgagatgggaagaggagggtaagggatagtggatggcatggcagcagagcaggtgggggtatggattgagttgtgtcctgccaagattcccattctgaagtcctattcccccgtacctcagaatgtgatcttttctagagctagccgtctttacagaggtaatcaagttaaagtgagataattagaatggaccctaatgcagtatgactgatatccttataaacaggggaaatttggatacacagacacacatatagacatcttcacgcaaacatgaaggcagtcatcgacaagccaaagagaaaggcctgaaacagatgcttctctgaaggaaccctcagaaggaaccaaccctaccaatatcttgatcttagacttctagccttcccgaactgtgagaaaataaatgtatgttgtttaagccacttagtttatggtgctttgttacagcagccctagcgtcctaatatagtagcgggaaagagagattgctcttttaggcagaccccgtcagagaaggagtcaattttaatgatcaggggaaggagctttccagaaagagagagcagcatgtgagcatgtgtgaaagctgtgatataggaacagatggtgtagaataaaaattttattttgaacccaaaaagtagtgacattactgaattggagtgttaaaataaaaaattcattggactagaattcaaaagacattggtatgagttctaactctgccacttactcattgcatatggttaagcaagtgtcttaaactctttgaccctcagtttcctcactggagataaactacccacggcacctatccaccaggctgctgtgaagtccagataaaatagaaatacatgtgaaagtaccttacaaagtatgaaaccttatgtaaatttagttgtggcagctgttttctcattgttgctgcagctggtgttattgttccagccataatagataataatgtgcataacgctatagtaaacagggatgtgccgggcacggtggctcatgcctgtaatcccagcactttgggaggcagaggcaggcagatcacctgaggttgggagttcaagaccagccttaccaacatggagctaccccatctctactgaaaatacacaattagctgggtgtggtggtgcccacctgtaatcccagctgcttgggaggctgaggcaggagaattgcttgaacctgggaggcagaggttgcagtgagccaagattgcaccattacactccagcctgggcaactagagctaaactgttctcaaaaaaaaaaaaaaaaaaaaaaaaaaaacccaaaaaacagggatgtgtctgctccagacatgcaactcatgggtcatgagctttgatgttacaagaatgcttgagagtctgttttggctactgtcaagtcatccatcttattttttagaagctaaaaaatccaagttcatgtgattttaattataaccatacttttatttaaagtgggaaggaacagaagattgtggtagcataaatcataagtcatctaatctcatttaggttatatgaaaacaagatggaaacctttgaagttagtgtgtttatttgctaatctacctccctcttcctgctgcacacatcacactgtggttctcagaattgttcagatgggaagtatttttttgcagaaatttttattttaaaaataataacttcagtgtctgctctaaatcaatattccgttggtcagaaacgaaccatcttagctaccactgttgcatcaaattttgcagctcatggaaataagccaagaggtttttatgaccattgataatggactaaaagaaaacccaagacagatagatgacagctgcaatgttcttggcacagctaaggtgggttgggagtgggtgtgaggagagaacaattcagaaatactttttaaaaaacaatctttcacccccacaatgtttgggggcttgtttatatgtatcattttgtatttttgtaacatattctattttaattttacctcattgtggtaagaccacttaacaggagatctgcccttttaacaaatgtttgagtgtatatacagcattattgactactggtgcaatgttttacagcagatatctagagctcattcatcttgcataactgaaactttaagccagttgatgagtgattcctgattttcccttccccgtacaccatggaaaccaccggtattctactatttgattctatgaatttgactagtttagataccgcatataaatggagtcatacagtatttgtctttctgtgactggcttatttcacttagcataatgtcctccaggttcttccatgttgtcacaaattgcagaatttccttttgaaggcagaatagtattccattgtatgcgtctaccatattttatttttccattcatctgttgatggatcttaggttgtttccatatcttggctatttgaatagtgctgcaatgaacatagaggtgctaatatctcttcgaggtcctgacttctgttcttttaaataaatacttagtaatggggttgcaggatagtattatagttctatttttaatgttttgagtaacctccatactgttttccatagcacctcaccattgtgccttcccatcaatagtacacaagggttccagtttctccacatcctcaccaacatttgttgtcttttttctcataagagccatcctgacaggtataaggtgatcactcattgtggtattgatttgtgttttcctaataattagtgacactgagcatttaaacaaaatttatttgttggccatttttatatgttttagagtttaatctatttcatattgtcctcttttctgtaataaattatgttttgttagaagatgcccatttgaacggtaacactttagttggccagtagagagttatttccagactgagtcaccatcagctgcatgtgctgccttgctattcatgcccccactcataagagcaggaagacaattcagtctccatgtactaggggtcctctgttcctctgctgatattcagactttataaactgaagaatgacatgaatcaatgaacaagactaaaccattcctaacatcttggtaatgcagtgttcaaaagatgttcttttcagatgcctagagcaaggctaaccaactgttatacactaactagtaactgatcatctataacaatagataacatagactggacactgttatgtgattcccatacattattttgttaaatctcaaaataaccctgtaatattttaagtgctatcaatatcctctcattccaattaaccaaatctctctgtgtgtctatatacatatatatatatcttataaatgtgtgtatgtgtgtgtgtatatatatatatgtacatatataaaattcaatcctctctacaaaatactacacttttcttattttcatcatatgggtgttatgttccctgaaacactgaccttgagaaataatcagccaattacagtagaaaattttaatgatttatattcaaagattgaagtcttactagatgtagcaatttctggtgaaagaaaagaaagtaaatgatttcttcccaaatggctcaaacagaaaaaacttggaagtagttagtgttgcatgtgcaattctctgactctcttttccaggctgatcatttcttggcagcatgcctgattatatctaggcagttacaccccagaaggtatattctcatagtcaggaatatgtgacagacacctctcgtactttaagtcaagatattatagctatctttacagctacacaatcatcatgatcttgcaaatctggagtcctcctggtgtcaccttttctgatccaaaggttcaaaatcgcttcaattctgtcagcatgtcaagtgcttacagtttctgagatggtgctggtggtttctaagggtgaatttgcaagtctccaaaactcctctctggagcttcttctggagatcacacactcaaatgcctccaggagccaaaagggtgaggtgcaagagtgagtgaagccaactgggttcaatacaagagacagtgatggtgctgaggcccctggagagtatgtgcccccaactagagcagcagctgctgctctgccactgccacaaaatgtcatgagggaatgcaggctctgtgtggccaactccagtcgttttttttttgttttgttttttgtttttcaagaaaacctggaaattcagatgtctgtgtaaaatatactgattgataaatgttggcaactaatacagatttctttcttttaaatacaatgcagcaagttcaccaggccactactttgcaacttacactttaggggttctcagtggggaagaaagtgccaaaatattctcctgcacttccctcagcagcttttcctctctgacctctcacaaccagaaggatatcataagcagtacttcccttccactaggaaggatatgagctttgaggaaagtgaggagcaggtccttcaaagaaaatcttgggctcccaaatccagccctttccctactgcctttggacagaggagtatgtaactcaagatcatcatagacaagaatgtgtgcatatttgggtttctccaaggaactacagccttgtagagcactgcagggcctctggctgaaataaggaagttgggaaagtaaagaaaaggattctattttcaatgttctgggcttaagagaacagcaaaacttccaaattaaaacaacttaagacattttgggtagattctcaatgagatttaagactaaaaattatatatttggcagctataaaaatagaagtgatatactcactcccccaatggggataccttaggtgccaaatttgtgtcacagtcaggactgggacagttggtaaattaacgtggactagaaccacccacagcagtgagaccttacagtgagctggagaggatgtctccaaccaggccatggagttggagacaaatcctccaaccagaatgcaggatttggaaccttggaaactcctaggtgattctttacagaaaagcaaagtctagcctcagggaacccagaaatggtggcgttccagtatccagacctgcagccgataccacagaaacctgtgtagagtgggaccatgaaaacagcccacttactagatcccagataatcaaactagttacaaatgagtttggcaaactcttagaaggcagggaactatgtaatcccttagaaaaattcttatcaaatgtttcagatgaatcccttctgaacttttacactctattcctcaagcagcattctccacagttcaacttttgctttcctgggccacttgaggaaggagcaggaacagagagagcagcaaaggtcctctggtcatcacaataagttctcagcccccataaaggccctcaagggtcaattgtactgtttccccaatggcgctgctgggagctgcttgattccacacctctacctggggaagggctgcagtgataatacacctgtttacagggcagagcgggagtaagtaaaacagacctcaaagaagatgaaggacagctttccattttttcttccttaggtctttagaattcatttgttatacctctctctaaatgattccataaactacatcttgaccacttaaaaagtaaaatggggaagacagcttaagccatcttttaaatcatagcaaatgccaagaaatgtctcagaggccctgtgatatccctttgcttagagctattttcattattattgttatttgccttggcagtcaaattctttacaagcagtctgatctgcaaatagtatgataataactttggggatgtcagccttgacattttattggtttgggcttcctgctggttcacctaggctatttcactttctaaaaccacacactttctatcccattcattatctagaggtccccacatccaggcagcagagaatgggcattgatgtctttacctagtgtaggacctctatacatctgtccagatatggggaaatagaaatccatcctctgaattctgtgtattctgagagagcttgaagtcagtttgtctgactagcaatatcctggtcaacacagggagggaggaagtgagatgagaccagccaagcagaagcattggccctttatagcaagaagccaacaatctatatcatctggtccaaagaggtagaatcctcccgcttcaggttaagacaacagtaatggccaaccataggagtagatgggcaggggcttctgagaggctgagggcgctaatgatgtctacacgatcatagatctagggatccagacctgatcatggaggatgggtggagatatggttcacctccagagaaatgggattgaaaacatttgatgaggggccaggatcattttgccatcagcttggattcagattcggtcccagctccacccatgaaacttgaatagactccagggccgaaagcagaaaactactcaaacagtctgctttctcttggcattaaggacactgcctccaaggcatgctgaccttgagggttatgatctccctcaagtcaccaaagagaaagtacaagtggagtagcttccatacccttgtcaaaggaggagatggatcttttaacctacagacctcactttcattgggccaaggtggggaccgagaccaatttattatccctaagagctgcctaggccaagaacaggagcaataaagaggctgaggtaggaaaggagaaaatgagagaaagggggtgggttattattaaaaacattggctaattcagatgaccatcttcaaagtgtccctgacttaaagtgaaattgcatgggcctagcataaaagctattaggtgggggcaaaagtaattgtggtttttgccatgaaagtaatggcaaaaccgcaattacttttgcaccagcctaata

SEQ ID NO: 994 - DNA, 213795 bp, Homo sapiens
attattagctgaaactgcagagaaacagatatttttatttttaaattatcaagtgcattcacaagacagaaaaaaacaagcttgtacaagagtgactcaagctggctgggcccagctgtacctgacacacagacttatacatccagaacaatgaaaactcagtgccatcagaacagacttttgggcggatggctgtaggcttcaccagttatcagtgccactcaacactttcaaaaatgccttttttttaaagttctacacagcgggacatgtttaccaatttttatgcctctacatgtgcagggataagagccaaatatatttttattagaagatatttcacactgggtatacatctgggcaaaatttacacctcaatgcccaacattgtttttctcacttcttattttaatggaattgactgtctaatttggataggtctttctaattttatattagttttcactttcttggggttaaatattttatcagcagaccttatcacacacttgagaaaggagtcaagaaaagaacaaaaaatgaatatcccattataatatcaaacttcaaaacatatagtctataataatgacactattattctggaacttagaaaaaataaataatgcaatataataatgtaaaaatattaagattaaaataaatattaaacaatgtaagtctacaaaataggtatgtgcttaaatatgaaaagccttttttaaaaagtaaagacattgggaacattgttgccagtccagccaaaaatcacttttaatttaggtctatgaagttacctatatgatttgatcttaagaaacacaaaattttaattagaaagtaaattgttttcttttaatgtctttgttactgagactgttttgaatgcgccatattctaaagctgcttatcttttttgttttttggagatagagtcttgctctgtcccccaggctggagtgcaatggcgtgatcttggctcactgcaacctctgcctcctgggtcaagcaattctcctgcctcagtagatgggattacaggtgcctgccatgagacccggctgatttttgtatttttagtagagatggggtttcaccatgttggtcaggctggtgttgttgaactcctgaccttaggtgatccacctgcctcagcctcccaaggtgctaggattacaggcatgaggcaccgtgcccagtcagctgcttatcttttaaataaagtgaatttcaaaaacagatacttcatattctgggcatagcatcacacatacaaccattaccaatataataatattaaatgattacttaacagacatcctaataacgcaaacaccttttattcacatttgctgagtagcaattacagtgttttcttcattagttttccaacactggtaatgtaattatgatgcaattactaacaatataagtaccaatactttgaccaacaatagtcacaatggtttataacaactgaactcaaaggccacgttgatttttccacccacaacttgattctgatttttctagagtcattcataagaacaagaagtagtggatcctttcttcctccttagtatctgaaaattctgaactctgaagagaaattccatttggtttgtcattttcacctctgtgcatttcggcagctcttaacttttcttcaattctttactggaaagaaaaatacacaaaatgtactaaataaacttgaataatgtcttctgactacaaccaaatcttagtgtgctcaggcaacagcacaggtaataaaggacattgtgtaaaacacaaacacatacaaacacaactaaaaaagaccaaaatactaatttcctatcttctagtttgcctctcaaacattgttagcatctttttgtatcattagcaattgtttaaggcctgctcctgcattgacaggttaatgtaagcaagaaagaaataaaatccccaaatatagacactaaaaactccaaaccataagtaacttccagaaatgaagagcaggcaatcagagtatatgaaattcttcattgaatgggaaaaaaagtcctcatggatgatattcagggttagtgattcggaaggatacagataattttattaaatagcattctttcatttagtctatggctatgcctacttttatataattaggttattacatttttcaaatcaattaaaaaatgggctgtctcatttttgaccaagatagtaacaatcaagcatccagatgtggctttgatgtaaaacaaattatacaattcataaaaatcaagaaccaatatgcagatgaaacaagaagttgcttccttagacagcatgtagtatttgcactacaactagtgtgagataaattagtggggctaaacctaacattttttaatgcaatcattcatacagcattgataagttctggacttacacagaaaggttactgtccttcttctaaagagaaaggcttaacacctggttgtccttagaaaacacacggcagtttcagaacgatggcaaatctggttaaggtagcagtcaactccatcgaccactcctgagaaaagtgacagctggcacactgtggcaagaaagggcaatggctaaccattcctgaagggctttccctgggggcacaggaggtgtaggggacacctgtgctttaaggaacaggcccaatcttaaatcaatggtcgcactatcttttcatataaaacacatttacacatgaggggcaaaaattctttatcacttgatgtttcttgattttaaatttgttaaacagagctactccaggtaagcttgtatcatatatagaagcccaaaaatacgttctagtgaagctcatgaatgcacatgaagttgagtataaaaatggtacagaatacggcatgccaaggtataataccactaggggcaaaaaaagtctccctgtacatatacagaaaaagtacgtaaaactttcaccaaattaggatctgataaaaatggaaaagaaagtagtttcaatgaaggctgggctaaagtcacagagagacatataaacttctgcaaaaggcagtgaggagggtaaaggatcttacaggaagaataaggcaaaacaaagtgagaggaagagttcatgttagtgggaggacaaaaaagaagaagaaaaacagaaaagggaagggggagaaggggagaagaacagctggaaattagtgagatggatcctgcacgtgcagaagatgtaggacaagtgaaatcaatcaggtggtgactgcactgtgagaagtaaacagagaagccagacggaccttcaggagaagaacccaaagagaaattcaactcgaaaaatctaaagtaggcagcaaagataacatctttgagggaaatgattcagactcagaagaggaagaaacacactggatagagaatgacaaagatggcgcataaaagggagaaaagagacagaataaagatggtcatgtgcacccttcggacactggcggctcctcctgacgatgggaggaaaatcaagagtggcacactggcttgatgaacgctaacagcaaaaggacctgaaagctaggagacagcagggatgtgctgaaagagggaggagaagacatctaaccaaaagacaaggataaatgcaaagccattccttctctatcttctcataaagtatctctgtaatctaacagaggaagaaagtaacgaagcaaagccctttttaaaggctcttgtgatgaaaagagaaagaaacattcttcttagcaagcttatgaaaacaagtatgaaactaggttagtgtttgtgtgtatgttatgtctggggaataagattcataaaaataccgggccgtggccgggcatggtggctcatgcctgtcatcccagcattttgggaggctgaggcgggtgatcacttgaggtcaggggtttgagaccagcctggccaacatggtgaaaccccatctctactaaaatacaaaaattagccaggtgtggtggtgggtgcctgtaatcccagctactcgggaggctgaggcaggagaatcacttgaatccaggaggtggaggttacagtgagccaagatcgcaccattgcagtccagcctgggcaacacagcaagactccctctcaaaaaaacaaaaacaaaacacaacaaaaaaacctggaccttaccccacaagacattcaatccaatagatctttcctgaaggtttacttctgtggcaagacaccaggctaagtgcaggggaggaaaaaaatgtgagtatgtattaaataatagcccctgactggaagcactggccatctaatcagagttaatatacaaagcaatgtgtaagagaaacagccctgaacttggggcaagaagattaattcctagttcaggtactttgtagctgtaactttgaaaccttggtttctttaaatgtagaaacaacacgctgtattagaaaatttctaaaaattacattcattttgaaagaaatgatcaagtagtaaatatacagtaagtagataaattagaaaatgcacaaagttaaaatagaagaaaaaaattaccataatcttactactcagataattattcatgtcttttgatgtatattatataaactattttataatcattttttacttaaaaatcataaacatcttttcatgtccataaaaatacttccataatatgatgaataaccatatgatattctgttatataaatatttcatattttaatcaaccctttattttaaaaacactgctcgaaggagtagccttttaactaaatctctccatgtatacttgaatactttcctataagagattccttgaagttgaactgtcaggtcaaagagatgcacattttgaaaacaaaacaaaacaaaaaaaaaaccctaacatattacctaattatacttcacaaagaatggatcaatcttatagtattaccagcagtgtaagcgggaatccacatcccattttctcatcaatactaggtatgtatcataagtttgaaacttgtcattttgaaagggtaaaataccatctcattttattgttttaattttcattaatttgatcaatggatggtaaacatttttcatatgtctgttgccatttatatttatccctttaagaatcctttaagaatgtcctgtgtatatctttgtcccgtttttctactggtgtattttttttcttgttgaaaaagctcctcttagagctttttatttgttaagggtattactcctggccaggtgcggtggctcacgcctgtaatcccagcactttgggaggctgaggcaggtggatggcttgaggtcaggagttcaagaccagcctgggaaacatggcaaaaccctgactctattaaaatacaaaaattagctgggtgtggtgacacgtgcctgtagtcccagctactcgggaggctgaggcaggagaatcacttgaacccgggaggtggagactgcagtgagctgagattgcaccactgcattctaggctgggtgacagagcaagacgtctcaaaacaacaacaacaacaaaaaaaagagtattactcttccatgggtaaatctcttccatcccaggttattgttcatttaaaaattctatgactttttttctttttgacctgcataattttaaagtttccattatttaagaatctgttttataatgttttccaattctggtatcaaggttaaaaataattccttagcccatgattacataactatgcatctatatgcttctgtacaattagattttagttttctacaatggaaaaataaaaatatgaaaattttgactctagttcctacaaaatgacaaatttataaatgtggacatgaacagcttcgtaacatttcaccttgaacagaaacttcacttctacttaatagagaaaaggccttctggcaggccttccctataccccaacccctaccatccaaacacattttcccactggcgtatctcggtggaaaaagtggcccactcttgagctgtaatcctctggagttccttaggcccccagggactatcactctgctccgacaccgcagatggctccttctcaagtggctctttcctctcagtttgtaaatattcttgtcattcccctctttataaagatcttgtctataccctgtgttttccactagttactgcctagctttttctttcctttaaattccagcttctaaagagaataagactattcttacagtctttttccctttgggctggagacaatctgatttatgcttccaggtttctccatcaaaactatcttctccaaggtcgcaaatggcctcccggttacagatcccaaatgggacttgtcagtccttattttacttgcctctctctggtatttgtccttgctgaccatgctttcctaaatcttttcctgttgacaacatagcgcaactttctattggttttccccttacctctattagagtgacttttctgcctgcttgcttgttcttcctcatccgtgtatccattatgtgtccttggtcctcatggctctgttcttttctcatttcagaactataggagggaaagatcagaaacaaggagccagtaaaagagagctgagctaaaagctcagatgaggctttgatctagggccgtggcagtggaaacaaaaatggggataaatgtgaggatatgacagagaaaaacatccggcagaactaatgagtatacacggggatgagagacaaggaattgcttaaaataacgttaacagacaaacctttggctggttgggctccttcttagccatgataaagggacaagaataaaataaatttcaaaatcttaaacaattatctgtggacttacagaataaaataaatttcatctgtctcagaaaaatattagatgcctgggaaaaatcagaaagttctatcaacttaggtggaaacacacacaaacacacacacacacacacacacacacacaaaagtataggacattcattcatgacaagaaaagaaatgaaggaaatttatatataagaaagctgtaacatcctgatctgtggaatgaacaatgtagctttccaaatgattcaatggcaatagcaaaatataaaacaaatgttttgtggatgagtgtgtagtaatgcactttatattaggagaaagaaaacacaaaaacaatgaaaaaaaaaggaaaactgaagaatggaacagagtatcttctaagttgtctaggaatggtgagaaacaccacagaggagcttgaaaaagatacaagaatttcaaaatcaggtattaaataggactgaatagagattcttgtgaaccaaatgatatttccccaaaattcacatgttgacacctgaactcctaatgtaactgcatttggagacaggggcttctagggagataactaaggttaaatggggtcagaagagtggggttctaatctaataagactagagtccttagaagatggaaagatgaaaccagagcgtgctctttttgcacagagaagaggccatgtgaggacacaacaagaaggcagccacctccaagccaggaagagaggcctcacgggaaaccaatcctgctggcaccttgatcttgggacttctagcccccagaactgtgtgaaaataagtttctgtagtttaagcaatgaagtctgtggtattctctgtggcaccctgaatagactaatgaagaaatgtgtaagtaagtgaaatgaagtcagatgactgagaatgaaaaggtcagaaattacaaagaagaaaggacagtaaatttagatagaatgataaaagaacaaaggaaaggttaagctctgaaaaaaagcactgatagcacacaatcttaatctttctgaagtgtacccttttggccttatttccaaggaatctatattctagactgataaggtgaataagggaagcaagccaaagataatacagcagagacaacgatacaatggactgtggcaaactggagaatggatgactcatctaaaggaggcagtctatctcagctcattgatggatgtcatcaaagaatgtagagctgtggtccagaactctggattattttcaagaagtcagaaatctgtatttcttttaggtgaaatatgtaaatatctgggcagctaattacacacacacacacacacacacacatacacaaacacacacacacaaagaccccatggatacttgctggtctgagggtatcccaggcactgccctacttttgtgccttagctcctgacttctaggccctattcttcttgtttaccccgtcgtgtctatatggtcttaaattctgtcttcatctttggctttctctgaccactaaagcccactctaggaagatcagactgtagtgatcctctttcttcttttatctctcacaatctatatacaatctatcaaaaggctaccttgaaaatacatagaacatctagacctttgcttgtagcccagatagagtaggaggaaccacatttacctcttgtctaaaacaacaacaacaaacctgaacaaaacacatgaaacaacaattttcaagatactgagccacagacgatgaagatctgcaaaaggtccccctcaagtatccagcagtgaactgatgagtgcacacatctgggaaaatcacttgaggcccggaacagtgtttattcccactagcaatgaacagaactgttcccgaggaagcccagacactggccttactagacaaagacttaaaatccgtaattaaaaatgtgttcaaagaactaaaggaaatatgtataaagaactaatgtatgagcaatgtctcatgaaatagagaatatgaataaagaaatagaaattacacaaggaggaagtaatactaaatctacacaaactattctagaaaattgaagaggtgggaatacttcccaacttgttccatgaagccagcattatctcctcatcaaaatcagcttaagatgttacaaaaaaattacagacccatatttctcatgaacaaaatgcaagaagttctaaaggaaattttagcacatcaaattcaacaagcactatcctttataaaaaggataacacaccactaagtaggttttatccgaggaacgcgaagttggtttaacatttgaatatcagtgtaactcaccatattaagaaatttaaaaacaaaaaccatagattacttaactaatgcaaaaacatgtttgagaaatcaaacatctattcctgacaaaaactcttaggaaagggaaactacctaataaagggcatttataaaaaacctagaataacatcatacttcatggtaaaagatcaaatgctcctattcatttcccacatgatcaggaacaagacaagaatgtctattctgactagttttattcaacattgtattagaggttctacccagtgttaacagggcaaaaaaaaaaaaagaaaaaaaaaaaaaaaaaagaaaaaaagaaagaaagaaaaggcgcccagattgtgaagaaagaaaactgtcttttatttgcacgattgtctgtctacacagaatatctcgtggaatccactaaaagctattacaactaacaagtgagtttagtaggttcgcataaaacaagatcaacatacaataatcagtagtatttctataaactagcgacaataccatttacatatgaaacatgtaggaataaatcaaccaaagacctatacactgtatgtccaagacctatacattgaaaactaaaaaatgttaccaagagaaattaaagaagttgtaaataaatgcaaagatatatcatgttaatgactcagatgattgaatattgttaaaatgtcaattctctccaaattagtatctggattaaatgcaatatcaattggaatatgctatagaaattgataagctaattctaaaattcacgtggaaatggaaagaaccctaaatattaaatagccaaaccaaatttgaaaaggacaaagttggaggactaatattacctgatttcaagacatactacaaaactactcagtaattaaaataatgtggtagtagcataaagacagaggaatagaaaaataatgggctgggtgccttggctcacacctgtaatcccagcacttggggaggctgaggcgggtggatcacttgaggccaggagtttgagaacagcctggccaacatagtgaaaccccatctctactaaaaatacaataaattagctgggtgtggtggtgtgcacctgtaatcccagctactcaggaggctgaggcaggagaatcacctgaacccgggaggcggaggttgtagtgagccgagatcatgccattgcactccagcccgggtgacagtgcaagactccatctcaaaacaaaacaaaacaaaacaaaacaaaacaaaacaaaacacccaacattagcttgtgtagtggtgtacgctacttgggtggctgaggcaggagaactgcttgaaccctggaggcagaggttgcagtgagccaagatcacgccattgcactccagcctggatgacaaagggagattctgcctcaaaacaaacaaacaaacaaacaaccctccccccaaaaaaaaccaaaagagaaatagaaaaataatagatagaccataaacagacccacatatatattaagagctgatttcagcaaaggtgcaaaggccattcagttgagacagagttgtttttcaacaaatgatgctagaacaacaggatctccaaatgcaaaaaaaaaaaaaaaaaaagaaaaagaaaaaaaagaaaataaactctgatccaaaactcacatcacatatcacacatacaaactaactgaaaacaattcatagtcttaaataaaaaattataaaacttctacaagaaaatataagagaaaactttagtggctttgggttggcagaggtttcttagatattatactaaagcatgatttgtaaaagaaaaattttggtaaacggaacttcaacaaagtaaaaaacagtttgctcttcaaaagtcactgctaaaagaataaaaaggcaaaacacagatcaggaaaaatatttgaaaatcacatagttgataaagaacatatttagaatatataaatgactcttaaaatttaataaaacaaataacctattacaaatgagcaaaagatttgaacagaaatttcaccaaagaagatgtatgcatagaaggtaagcacatcaaaggatgcttaacatcattagttgttggggatatgcaaaatcaaacaacaatgatatatctctacatgtattggaatggctaaattagaaggactgaccatatcaagtattggtgaggaagcagaactcatacatgttggtaggactgtaaaaaggtaaaaccgtatggaaaacaatttggcagtttcttaaaaagttaagcataaaccaactatatagtccagccattctacttcaagatgtcacccaagaaaaatgaaagcataaccttcttcaatgcctctttcagtgatatgatgttaaacaaacaaaaaaaacccctatgttcacacaaagacttgtatataaatgttgatattagcttcatttgtagtagccacaaaaacttgtacataaatgttgacattaactttatttgtagtagccgcaaagtggaaatgattcaaaggtccatccacaaaggtacatgaataaacaaactgtggtatttaaaactctagacagtgagagaaagtagatcagtgattatcaggggatgtggctcagggaagggaagaaagatgtaggagggcaaaattacaaaagagcatcagaagtcttggagagatgggtatgctcattaccttaattgtggtgatggttcatgggtatttacccatgtcgaaacttaaaccgtttattttatttaatttcattttatttttttgagatggagtctcactctgtctcccgggctggagtgcagtggcacgatctcggctcactgcaatctccacctcccgggttcaagcgattctcctgcctcagcctcctgaggagctgggattccaggcgcctgccaccatgtccggctaatttttttgtatttttagtagagacaaagtttcaccatgttggccaggctggtctcgaactcctgacctcagatgatccgtttgcctcggcctcccaaagtgctaggattacaggcgtgagccaccgcgcctggccgcaatttattttatatcaagtgtatctctttataagttagaaatatatatgcatacataaaatctgacctcttttcactaacttcatggctcccacttttttccgaggcaccaccaccaagtctcacctggataatttcaatattattttaactggtctctctgattcaacccttgtccattaatgtctattcttatcttaaatgtcagagggattctgttaaattgttaggtcacttcctgtgtttaatggcttcctacttcacttggtgtaaaagccagaagtcttataatagtatataaggtcttattactgtctctgattttatccaatctctcccagtttcttactctactctaaaaagcctaatttccttacttttctttgagggtaacaggtatgcttctgcttcagggcccgctgcacttgtgttctacatactcacattactcaattccctgcctccttccacttttctcaggccttctctcatgctccgatttacaactgcaaccttcatgtctcctttcctttcccctacccatgctttatttttctccatactgtagcacacatctggtataattagacattttacttattttgcatataggtaaataaaatgttagctccttatagcagggattttttatctgtttactgctgtaccctcagtgcctagaacactgtgtgtgacactgtaggtgctcagcaaatctatatttagcaaatgactattacgtgtctgtcttccttgccacactgggcacttccacaatgtacaagttgtgtatcatatcattcatcactgcatttcagtacctagtatagcacctagaacagagagcagatgatcacattttcccaattggactgatgctcacaaatgaactactgacaccttcaaaggctaatcctgacccttcctctttatggcagtagcatcgaggtctaggacaagaccaaattcttgatacagacaaataatgtttgctcaggctcatgtaaaatgctgggcaaatacagcaagacatgtctcctggccccaccttccaatcatcagatgccctcaagacactcacattgcattcttctagagccacaatctctatcctgtttttttctcccactgcaattccccaactccaagacactaatcagtcagtctcctcccactctctcccctctcttcatagccgtatgctcctttaaactagttctttcccacatcacatccaaatgccctcccatgaggcagacaaaaactcaagccttacctttatctagaggccttctctagctatgcatattcctcctgccttctcattcagctctcttctgtaattacaatttgcatcacatcattttgcacctaattatataattggttgccttctaaatgcttcttatttctatttcctcatctgacctgtaatgcttctttaatatctctcaatgcatctagctcactgctgggcacactgtgaggtcacacacatgacaataaatgcctttaattttagaaattgggggtaggatgaggattaaaaaaaggcagaaaacggataataaaagtaaaaatttagaagaaaagtggcaagtagcaggattattttagaaaaaaaaatgtggactataaactacctcctcataaagagaaatgaaagagcctggaatggttattataaagatggaaaaaaatatacagtggagtgacaggatgcttggaattgacatttatagccgcaccatattaagaagagatttcattcatttagttcagatttcagggttaataagactttaatatgattaactatatgaattaacctctctctgaacaaagctgttaatgaaataaaggttgctatgttaaaaaaaacccaacaaaattcaatacaggctatattagttaactatggaacattaatactacttgttaaggatgacagcatatttatagcagcctcattaccaactctgacttaggcagcagataatatatgaagaacatcacagggcatgcggtacaaaatgtagaagtttaagattttcaggaaaatacttttgttaaattaaccaatagaagtttcttctagataccttaaaaaagagaatgtaactttactaaaatgtgtataaattgcttgcatagaagtgactgacatttctcaaaaaaaaaaaaaaacaaaaaaacaagacaagaaattcaagtggaaagtagtaagaggctgtctatgtggctcatttacatatattggtcaaccaactaataagcaaaagttacaaactcaaaggcagggctgcaaagaaacaaaaaattagcctctgtccatttacttgggtacaagaaactcatttaggtaaatcaaagaaatgacttctttgtacatgctgggctctagtgtttccaccatcaactcgcctacagttttcaagtcatgagaaatctatcttaattcatccttacttctaagaaattgtaagtagggaaagtccaaaagctttagatgaacttgggcatttagacatatctgaacttctcatgaaaatttttattttcagaagcatcttcaaaaagagaagctgagctatactgacatcctttagaagctgagatgtttgtgaggttttattgaactttaatctggagggcatgacatggatctctgtatctcgtgaaaactggtatgaaatgtagaccgagtgaggagtatgtaggagacattttttcatttgcgtaatattaagtaaaaagttctaaaaatttttatgaaatatgttcaaagacaccaagagcactgttcccatgatgtgttaaacatggtcatttttttttggttgttgaaacagtctgtgcttattgtttctagtgtattttgttgttgagtatacgctccttagggtcagtgactgtttatctactattatgtaaaattttaaatgtccagagactggaactaaaaacatatctgactgataacagtaaaacaagaaactataaaacctggagagattatagaaagaatttctaaggtatcttctagatcatgattctgtgactcttaaaaattacatttgtctttcatctgtacaatgaaatactgtcttgttaaatgctgcatgattttattagacaattcctgtaaataactgtcatctgaatcagaatttttgtactggaagagacatattattcttcaaattgccaaagcatatagcagggttaacttgaacaaatattttccccaaggaagctcagcagggattgtctgtgtgcatgtgtgagtaagcaagcacccagcaatgtacgtgggggtggtggtgatgggatgggagggtatgatagctaagctgttcaatgctgtcacacttccgttatattttgttagtaatgtaatttgaatataaagtttggacataatgttaggtccaaaagataactgaaaatgataaaaattgagaaatatgttgggaatgttttgatgtaaaatttttttttgaggcaaaagagtgacttttgatgggtacattaagtgacacagcaagtactaattaaaaatataaaaactttccagagttcttttaaaataaatacttcaaaataaattacccaaatacattaagcatttatagaaaatatataatgacaatgttctgcttattagcttttttcttaatgcttcaaaaaaggcattcataattttacttttaatacacgttcacttgttttcagttaatgttatttcaaaatagtactcaaataaaaataaatgacaaaataggtcctctaaagttttgtgtgatactagtttaataggatttcttataactttgtaataatacacattctcagagtccaactattaaaatattcattgtttaaacagccaggcatggtggctcatgcctgtaattccagtactttgggaggccgaggcaggtggatcacctgaggtcaggagttcaagaccagcctggccaacatggtgaaaccctgtctctactaaaaatacaaaaattagctgggtgcggaggtgcgtgcctgtaatcccagctacttgggaggctgaggcaggagaactgcttgagcccaggaggtggaggttgcagtgagctgagattgtgccacggcactccagcctgggtgacacagcaagactctgtctccaaaaaaaaaaaaaaagaaaaaaaaatcgtaaacaagctaaactcctttaaaatcaactatctgaaatttaacttatagtttgataatgttataaaaataagaaatggagaaattatccttaaaagaaaaccccaaccatttatcactgcaaattattttgaagaagttgcttactgtgtcatagattctgagcctagtctgaagtcctgggacttgttcttattgattgattgctgtggaagaagaggaaaaacaagtagtaagtaaaaaatgagaaaagacaacacagtcaatattcacatgctgaaaacccaccaacttcctgaatggggagagaatatgcctgttctgaacaggaatatctatgcctgtcctgaacatatattgtctatcaggacaatatatttgctcccatgaaaaaccaaggaagtagttctccagagagttcaaacactcatttataagtaaagtcagctttcaggtatgtgaccaaaaaaaaaaaaaaaaaatcagttgtgaatcagtttaaattaatctcccaatacaatgtggtatattacttaagctctaaatatatcttttagcctgcatctttccttcatattctttatagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttgtgaaataaattctaaacacagcagtcaaattaaatgtgaaatgttttattcttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgaaaaatgaataatatgttgccatgtgcaggtcttgccaattctgctaagcctgttcatgtgaaatggatgctgtgatatcctcagaaagtttgtcttaggtatgttaaacatggtccctgccatcttttctactgtgtattcctatcactggcatacccaaatcctttttaatgatgcagaggcagcttagcctgtgttcaaattatatgaatcctaagttagaagggggtccacattacaaagtttaccacttacttgaaaaggacacttacttaactaggaccaatatttgacttccaaacacctttactcactcattccttggtctcagcagcagcacgtcatataggtagttactcatggaggcagaagcagggggaagaaggaggtgtctctgtgagctgttttgttttattttacctttaaacgaaaaagcccccaaggctggtgttcaatcagcccgcaaataacccccaccatcgacaacgccaaagaacatgactgcccttctttccacacacacttgttagaaagttgttttatgactttgtttcctcttcatggatatcattgatttagagaggaggggatgaagagaggaaaaacgagcaaagaaaaagtgacgagtgaaaggaccagaatctagagacttgcgctttccaaaccctcacaacttgttagtgatgcttttaaatttaaatgcaatgatagttaacataaaataaatgattaatggaatgattaaatgcttccactgattatgtggaaatttataaggaagaaaacaactcatagatagctttgtaaaagagaaaggggctatgcaaacaattcccccaaatatttttataaacttgaagaatgaatataaaattaggttaatgttcaattaatgtatgttacatctagcacacgagacttaaataaggcaaatttatgatacggtatagttctatttttacatgcggcttatatacctcatgatagatataccttttccatataatttcatagtttgtttatatctactttgtaggagtttttaaaaaaaggatgtgagagaggaaaaacaactaaagttggtggttcaattcttgtcttggttctgtcattaactctgtgtggcctgggtaaaccacttagcctctcttggggtcttttttttttttcacttgaaagtaggtgagggttcaaaataaaaacataagcatcatagcaccattctcttattttacagaccaggaattggaggcccagagttaccaaggttatagaggtagtctgaaggttatactagtgtttttcaaactgatttaatggcaaaactattttcaatacaattttattcaaaaggctcatgtataaatatgtgaaagaagaaatactctgggtgaaactaggtttgcatggcctggcaccccctgcttcccaaccctatgcccccagatccctgaggaatagggctctgtaaatgacagtttacaaactactggagtatacaagctctaaacaagactagaaaggtttcttttattgctacaactctgtttccgggagcacaattttaggattttaaatattcacataagtttgaagttttctttgactttagaatgtatgtatgtatatatttgtttattcacttactttctaatttgagacaggatctcgctctgtcactcaggctggagtgcagtggcgtgatcatagctcactatggccttgacctcctgggctcaggctaacctgtgggctcaggccaacctgtggcctcagtctcttgagtagctgggactacaggtgtatgccatcatgtctaatttttttgattttttagtagagatgaggtttcactatattgtccaggttagccttaaactcctggcctcaagcaatcctcctgccccagcttcccaaagtgctagaattatgggcatgagccactgggcccggcctgatttcagaattactgataatgtatctggtttacttgatgttaaatcctccaattataatgctcttccttaagggaaaaaattcttctgtattaagatgcagtttctagaagcatactgtaacaaaaagtgaagaccgccgggtgtggtggctcacacctgtaatcccagcactttgggaggccaaggcaggcagatcacaaggtcaggagtccaagaccagcctggccaacatagtgaaaccccggtctctactaaaaatgcaaaaattagccgggtgtggtggcgggcacctgtaatcccagttactcgggaggctgaggtaggagaattgcttgaacccaggaggcggaggttgcagtgagtcaagattgtgccacggcactccaacctgtgagacagagcgagattccatctccaaaaagtgaagaccatcctgatcacgatttgtagttttggatactaattgtgccaattaaaaacaataataaatacttatctgtggggcagcataattaggagggtgttttggaagataaggcaaaataggtgagaacatctatttaatctttgaggggtaagacctagataaaaacttacgagatttggactttatagacaaatatggagccaactaagatttatgcactggtaagtcacatgatttgttttctattttaggaaagtatcttcaggaggcaggtaaaaggtgcaatgaagactgaagaatgggagaatggatactgttatcagcagagaccagaaggctatataccaggcagtggctgttacacagaaatatccttcccaagttcgttcccttcaattcactctaaaaaaaaatggcattccttaagtccccgtcttctaccctttgtcattttcattcttgacactcctctattcccgtggattcagatatcaagttttcttcagaatgtaacaacttagcaatggttagttttcagcaaagcaagtttaaatatagcaatttttctggaaatatacttggattcataaattgtaatcaaaactatcttgcaaatatgagttttcagcaaatctctcttgagcctcatagatgtctgcaaggtatctgcaattggttgttgcaggtgctatgaactttacatgtctcaaattgaagtccttcctacattcttaaacactgagatgtttcaattagaaagtcagatttcttttccttcacatggatttagtcaccaattcctagctccttattatttttggcttgaattattgcaacagccccttctggtcttatttctttcagtaggcttttcccagtctttcagagcttctagaaggagcttttgaaacaaccaatatgatcatgtcatccccttgctttaaatactttgatggctccttactaccttcaggataaaattcacctccttaacatgccagccaaggacctcctcaatcctgtccacttgttcaggtctagctttttctgctttcaaccttgcatcctaagctgcagccatgatgaaacatttctggccacagcaggcttttgcacatgctgtttctaatgcctcaaacaaatcctcccacccacccggctcctcttaaaacctaattcatccacttctcaccacatggtctcatagtttcccttcactatccttttattgcttttatgtttcattttgtgactctctgattaaagttactttcacctgttagactgtaagttccataagtgcaaggactatttttgttttattgaccattataccatccagactgtcttctactacagtgcacagaaaaccagcaggcactcaaagtatgtgttaaatgaataaataaaaatgccaatgctggtaggtgagtggggatggggatcactgattgaataaggaccagaagaatgtgagaaaggaaaatgaccaaaagcacaactggagaggtctgccatagaaaggaaaagcagttccttctctgatacctgaaaacagctgcaggagggtaaaattacagaaatatagagaaagtagggatgaaaatgtgaggggattcatattatatggcctctcttcaagaaagcagaagaccaagtcaacttggagtaagaaatcagcagcttgagtgagaaacgtggacattcttttctgacctgctgctgtagagaatggggtagagtcagtagggaaaaacaaaaaagatgaccaagaccacgggcctcgctgaggaaagtaatcacaaatctcatgaagagacagtgtcaatacaatactataatttttacaaaagctatggttaaataccagagtagaagtgagaaaaatgggcaacttgttgtgcccccaccaatcctgggcactagtgaaagaaatggacaactaaatgtccccccaccaggcctggggattggtgagacaagtgaaacactccaagtgctaatgatgcatctggcatcatattgctaaataatcctgcttttatttcctagtggtctgagaggcccggtttgagaagaatgaaaactgattgcagacaaccacggaagcaagaagcaccagaatgcactccctttcttagaattcctgcaaactgaagggtcattgggttacccacttcctcttttgggactaaactatttcctaatctcttatcactagggaatagttcttcccaaaccaggtcacccaaatacagtggtgtgtaagaggtggctgcttaaaaacgcctatagcaatggggaagcggtaagagaggtaaaaagagaacagactcattaagtacaaaaaaattcaaataaaagagtaataaaagcaaatttgttccaacatgttgaaacatcttttattgtatgcatggcttgtctgaataaaagacacacttaaataagaaaaagttcttccctttttatgtacctaaaggggaaccatattaaaatgagagaccaatatgacccattactgtgactgctaagtaattataaaaataatagcatacagttgattttccatagtttatgaaaagattagcgtatgtttaacttctgaaacaaaggaaattaacattagtcaatagatatctaaatttaattattagacattttatatatactcatcactttgagtctcacaaagctggatatatctttatgtaaaattcttgtttttaagtagggtagtctacagcttgtttttaagtagggtagtctacagctcatatacaactactcatatactggcagttaatggaataatgtaagcaaaatttcattacaggatcttaaaatgaaaagctttttattttacttatgagtgttttttcctttaattacaatatttataatatgtaattcctttaatacttataagtgttttttcctttaattacaatatttatattgtaatttatatatattatacataaaaattaaaatatagcagtggttctcaactggagagtgaggggtgattttgacccctggggaaatctggccgtgtctgaaagacatttttgattgtcacaagtgggaagaggtgcatctagtggacagaggccaacaatggcactaaccatgttataatgcacagcatattcccaacaacaaagaattatccagccccaaatgccaacagtgccgaggttgagaaaccctggaatagaatggttgacaaaacaagaggacagcagagttagggtgacggagaacttccaaaaaaaggtcatgctgcttgtcgagtcagaagacacaacgactgatactagtcaatttggccactgtctaaaggacaatttatgactaggaatgatgggtgggaagttctctcaataacatctttcacattttagatctgtagcagacttttagagggatgttactgatatttaggttaatcctccgctttttttttgtgacacagagtcttgatctgttgcccagacttgagtgcagtagcacgatcactgttcactgcagcctcatcctctcaggctgaagcgatcctcccacctcagcctcccaagcagctgggactacagatgcacactaccatgcctggataatttttgtacgttttatagagatggggtttcaccatgttgcccaggctggtctcaaactcctgagctcaagcgatccatccaccctggcctcccaaaatgctgggattaaaagcatgagccactgtgccctgctgaacctttgaaaaaacatcatgaagagcaaatatgttacctgataaaaacaagccttagaatttgagaatttatagtattctctaaactaagttttaatggaagatctgtgtaagaaaatgagatgtggcagagactaagctcagagactcaaatcagctaaataaggagtgggttgctaaacagaaaagcaattcatccctaggttattctgtgaaacttttaattaacgagaatttaggaagatatcgaggaaatgacacattccctaaaccttgttctgaagttaaactacagggggattctctcatgttcctttcatttcagaaccactggcaattatctaggtcctgccttcaggctggataaactgagaagataagcagcctgcagggtctcaccttgtagagagttaagagggtcctggaaatatggagagcacttgcccaaagtggcaagaaacagggctgttgtgggagaagagacacagtaggggctgaggtacatatatcaaatacaatggcagaggcacaggtggaaaagaagcagtcaaacaagttgccagaccttcaagagaataaaggccttataagttcctttcggagtaggagagagtccctattaatttcttgaggctttgagattcctctgcgtaggtcatttcaggactctattgttgggagtggaatctatgggtatgaggtaaaggtaactcacacaggctttgctgttacatcactgggataccacccaccttctttatgggacacttatctctctagactccagaataacacatattattcaaatgtaaataacatttatatgaaattaatacttttttctcaaaataggtgttataagttattgaaacaaattaggggaaagaaaaaacatattagtgctatctgcattgaaattcttcctgggacacaaataagcactttagttttttttttttttttgagacggagtttcactcttgttgcccagcctggagtgcaatggcgtgatctcagctcactgcaacctatgcctcctgagatcaagcgattctcctgcctcagcctccgagtagctgggattacaggcatgcgccaccacacccagctaattttgtatttttagtagaaacgggggtttctccatgttggtcaggctggtctcgaactcccgacctcaggtgatccacctgccttggcctcccaaagtgctgggattacagacgtgagccaccgcgcccgcccgcaggttagttttaacttacttataaggtaaggcttcaggtcagtttcatcactatccttgatatatacaaagttagttttgattcagttctcttcagataaagtaagaaaacttcaaatattacaaaaagtttaaagcaaatccaagcataaattaattttattaaatataatagaaataaatcactgtattttctttgaacagaattactaaagtaaaaaaatacaaattgatattattctttagcaatagaaaagaagcaacaattatgaccatatttccaatgatttagtatatattaactaactactggctatttggaaaacctgtttcaccataacaaaaatctgcactgtctattataaatttgttgttggacttaatataataataaatcatattattcctatgattaacaataattcagattcattcctggtacagggatcagtaaatggaaaaaaattttctctataaagtgatatttgaaaagtgttatacagcacaattattagatactttgaagactaagaaaaacacatgcacattgagggcaatatatttattgcctaccatttttctgagaggctgacagatttaccaatgtaaaattttgcgtgtatgtgtgtttggctggaagaggaactaccatgaagttatctaatgcttttgggttctctgttcttgttttgaactaggcaagaaagcagctgttcctgaaaataaccagagtgtacactttggtttagaatagtctgtcctttggaattaagccagcatgctcttattgactctacatgcttaataaaataatgaaaattattaagacattcctctgctcatgtgaagattagctataatagatatttttataattatcttgaatagcaaaaccaataactgttattcatttagtgaatttttagagaagaatataagcaaaaataacagtagtttctccacatcttcaaaaataatctaacatttctgtgcatacttattactgtacatctagcatttatataaaaacatacttgactgtattaatgttgaaacactaatagaaggtaaatagtactttactactttgggttttgttttttagaaataaagaaaaaagaaaacagcattttcaggaattaaaaaaacagattttaggaattaaaaaaagaaaactgggtattttggtacctaaaaatggttaaaaaataggattgtctctgctaataagaaaagaggccaggagtggtggctcacacttgtcatcgcagcactttgggaggctgaggcgcgcagatcacttgaggctaggagtttgagatcagcctggccagcatggtgaaaccccatctctactaaaagtacaaacattagcagggcatggtggcccacatctgtagtccaagccactcgggagactgaggcaggagaatcacttgaactgggaaggcagaggttgcagtgagttgggatcccatcactgcactccaacctgggtgacagggcgagaccccgcctcaaaaaaaaaaaaaaaaaaaaagatgtcaaagatatattgaaaaaagaaaaagcagaatcttaagtatgatcctagtttcataaacataaaaaatagacaaagacgtgtatttatatatgcaagaacatttttgtaagcatatgtaagaaacagaatgagcataaatattagcaggacagaagactaatttttcgttttatactattcttcactggttaaaattttaaaactatgaacatgttattttttatagtagaacaactctagtaattaaaacaaattttagtaataactttcctccccaaataaatggatcataaaggttaatgcttaggctagcaaaaataaaaaggctaaaaagcaaaaaaagtccaaaacacaaaaaatagaacaaagtttgtcagcactactcgttttcaaagcttctgagtttctctccttcctgataatacttatattctcttttctgttagatgcaatttgtagcacaccttggtaaaaatgttctggaatgaacttggaggaaaacattttcctgctcccactcccctgtggtataagttgttactgatttgtttcgggatgattaactcatctcgtcccctcctcctccagtgaagagccagcaacaaatgctgccatcacccactaacatttcaatgaaccagatgaaatgctggaaggtacctggcacaattagcaacagagcaggtgtgttccacttggaagaacatgtaagatgcagcagctgccaagctattaagaggtataattttgcttcttattctatagcttgaaaataaataattttaaaaaggaaagaaaatgattgaggtttgtttccttttttcattaaaaatatagagtacaattcttaaaacttacacatgaagaagggtacaatgaaacaaataccaaacagggatgtgggctgggcacggtggctcatgcctataatcccagcagtttgggaggctgaggcaggcggatcatttgaggtcaggagttcgaggccagcctggccaaactagtgaaaccctgtctctacttaaaaatacaaaaattagccaggcatggtggtgcacgcctgtaatctcagctacttgggaggctgaggcatgagaattgcttgaacttgggaggtggaggttgcagtgagctgagatctcaccactgtacttcagcttggcaatagagtgagactgtttcaaaacaacaacaacaacaaaaaaaaccaaccaaccaaccaagcaaccaaacaaagaaaacaaaaacaaacaaaccaaaaaacaaccagggatgtaaaaaaccagtgtgatacagaacctggctaactgtgcaggtaccaactgtatgtgtgtgttgctaactaggtggtggaggaaaatgggcactggcctgagaatatggaggccatgctcctaattagcagcatcattttaaacgaacttcttatagcttcccggatctcaatttcctgtagaatgaaggagttgatcagaatcaccaaggatgttctctaaggtcctttccatgtcactagttctgtaattctatgaacttagatgccccacaattttagtcactttatcacagacgacttttcatgttctttcttaaaaaaaagtgataataaaaataagacttgaacatgaaattaaatatctgatagactctgtgggaggtttataaggtaaggtcttgataaaatcaaaccatatatattttaataaaggagctaaatttaagaaatgcaactagccaggtgctaagaagctcagttacacgtttctcaaaagttggctgttagttccatgactcagagtgcactcaaatcattttaattactcgaggcaacattatatttcttaggggcttcttttccataaacatagatcatttgttataccttctctcactgggaagtaaaatactgtcttacacacatagcacattcctaagagaaaaaaatatatgcaggattctactctaacacgtggattcagatagagaagatcaaatcatgttcttcaacaaaagaaatccacgcatcttaagatttaaagcctaatttgagttccatatcctccatgagaacattcctactcccttgcccaaatggagttttatcctctgccactcctttacatgactctaaattccttaaatctattagaattaaggtttgggcatcagtgggattagcctgaagtagacctcaagggtgactgacgatggtatctgaagaactggtctgctgcaatatgaatatgaaggtatgtttgaagcatggagatcactctatgaggggcaaaagtcataggaaatttgaaaaatcaactacagtctaaactaagactatgatgcagtgagtccacctaagtagagtggcacaggcagtgagaactgggaagttttggaaacaagtaggaggtccctatccataagaacacaggcacatcaggaagaggaaggggcaataccaacttcacaggtaagacactgacagagttctttatgtttcctctggcagagtcaatgttaactcaagggtaatagaaacatactaagggagggggggtcaggtcacctcagtttcaaaggttaccgtgttgcagagtcagggacatgagaaaaatcacaaagagtaaagactgtatgtttcatagcatcacacagtttttaatacagactaaaagtattgttagctgtcacagcaaccctttacaccaatgttataaatgcttccactgcattaaaggtttttatgttgtaaatttagacctcaggtttgtgttatgtttgtgttaaccttatgtttatgttatggacctcatgtctgtgtaacccccaaattcatgtgttaaaatcctaactctcaacaagatggttgttaggaggtatttgggaggtaattaggtcttgagggcagagccctcataaatggtattggtgcttttataatgagagacacaaaaaagcttgcttcctctctctgctctctgcccagtgaggataagtgaggttgcaaaccaggaaggagactttcaccagaccctggatctgccagcacattgatcatgaactttccagcttccagaagtgtgagaaaaaaattttgttatttaagccacccagtctacatttgttacagcagacacaactaagacaagcattttcctaaattcttaaatctgctgctgaattacaaacaatgggtaatattacacttgtaacatttgcccataatcaaattcctgccaatcctcttgactgtatcccttacagtccttacattgttgtaggcaaccatcaccatatatccttgcttatttgaaactgatgttttaccaagaaaccatttttctttcagttccttacagcacaggctactcattctcacatagttcatggttctctcatgaaccatgagagccgggagttaacaatggcctcctcttagttccctactgctgattttagggtattgcaatgccaaagcacttttccttgggtgctctgacacctggctattacatctcctgcttatctttgcatctgtgatctgcagaccttgtggtcattctaacacaatggctgtcaatattggctgcacattaaaattacctggaaagcttttgaaatctgcccttgcctacgtcctatttcaccaactaaatgtatttgaaggggtggagattgtaatccatatctagttttttaactggtttggtgatttcaatgtgaagccaaagttgagacctttgttctaacctaagaattaagtatgtcagctctttgttcatcagtttcctcttcatcctaactcttgctatcatcctggaatcttaatgttcaagagtacaacctgtccaacactctgggtcctagttccttgaccagttcaactctaataacatgttcctcaatttcacttcagcttttatacatactttatgaatttatcataacctgagctgcctgacatctgagatactaaataagcaaaagagtttatggccttgaactctatagttctagcttggtgactccttttccgtgtgatgctatgcctctacctgggccccggtagcttgctgtaaccttgtagaggagaacgtgctttctaactctgccaatcttctgattctacgtcctttccaaatggataatcctctatggtgcatcactctggtaattcttaccaattctatcaagtctctcaacctcttgtgttcctttcacattcacaactccaattatatattaaaccaaatctgccttctctactgctatgccctagatgctgagaagagactactgaagaagaaaaaatccaactgtagatttatgccacctccattcttatggtatccaaaagagcagctcccagaactactaagaaatctttttatatgtcctaaatgagcccctattttccttactcagatggttattattcttcttgtgctcctatctcactcctttgccactcgcattagaaatgaaccttgctttttgttttggagaacataaaaatatctttaatttctagacttcaaccctttattaacttatctgcatccctatccacacttacctgtttagaggggcactgctctaagctccatcctgttgacatttttggccagagaattctttgttgaggggagctgtcctctgcattctaggatactgagcaacatccatgacctctgcccaccagtattatcccccaccttgtagttgagaaaacaaaaaaacatctccaaacattgctaaatgactcctggatggcacaatcactctcacttgagaaccctctgcttggagcaagactgatctgtcaacctgtctttccaataaagtacttcctgcttcctccaagatccactgtgtccttggtgtcctttctttatctgtcttcaacctgaacctgtctattggctttgtctccttaatatataattttacatctgtccattatttaaaaaatcattcatggacaccagacctccctttagccactgaggaatctttttttattcttcaaagtgaaactttgagaatggcttccatgagagttcacatgctgaggcctcattccacctttactctgctctttaatccttgccactctattgataccggtacaaagctaccagggtcctcttgatgaccaaatgcttcgacaacctaactgcttggctgtttccaactatactcttcttgaacctctctacctcttctggcttccagggcacttttttctgtttattattttttctttttttccttttcctttattctttcttaattttctcttcctttgactgtcccttaatactagtgtttaattaggttctgtccttggccttctcctcttatagctctatgacatactttctgggctctgccttcattacaagcttccacttactgatataatagaactaacacactaattctcatttgattttgaagctctacattctctcaaattccaatcctgcatttctggctcccagtgaatatttctatctgggagcactacagatactactaacaaattgagatatctaaaactgagcttatcatatcttactctgcaaggaatggtgattccttttccctgtcttcccaaatctttcttatttatttcattacttctatggcaccactatttattcagttgtctaagacccttagcaaaatcctagattccaacttcactaataaaatccaatcaatcataaaatcctgtcaattacagcttatgtcccctgacctccatcccccctagttcaggtttttgtattttatttccatggattcctaatttccttgtgctaggtccttagctacctcaaattcagcaactattctgctgcactagaatgacctttctaacatgcaaatctgttcatgtcattccctgaattacgtccttcaggggatccccttcgtcaggagtataaaatttaagtgttttagtagagtatgctacgctcttctgtggcctggttcctggatttctcctgtacttctctctattagaacttatgcccagacataatcataccatcccataacttactcacgttattccctctgctggaaaggtttttctaacttcactgacctaacacatatttttgcatcctagatgcctcaggtcaagtatttcctccttgggaactcttcatggactcccccagggtatatttaagaggctttctttgtatgtgttcccaatatactgtgtacatatctgcattatagtttctaccagagtctactggacttgcttgcttgcaggtgtgtgcaccagcctgtaagcaacttaagggcaagtgccttgcctactcctgaaactcctgtttcagtggggattaatagagcgcatggatgaaggcattcaataaaacatgctgactgactgaatgatatacgtcaggttcaactgtcaaaaaactttattttgacactgtaatgatatgtacatgaaatgtatttgtaaaaaaaatctatgttggttcatggaatcaagaagcagtgaggttattcagtgtaagggaagagctaatttaatataataaaacaagtttagtaagcaatatacatgatagtacagtgcttattaaacctttctaccaaagtactgctaacaacagaagaatactgattaatatccctgaagggtctgatgacacagactaaaatacatgacatttctctggctactctggctggtaatacatccacattcattttaacgtaaaaacattttaaattatttgcaagtaaaaggaatgctccagaaagacagaacttcttaattttgtgaactccagtgagctctagcataaatgtttacctctcaggtggggctgatgacactgtcagtatcacagttaaagaaataagtgcagagtagaaacagcacacctaaagccacaagttctactttgggtccttgtcccatcacttaggctgtgacttggagtctactttaacctctctgggcctcctcagtttccttatctggaaaatggctataacgtttgccttatgtatttcataatgatgtttgtaccaagacataaaaaataatgtgaacaatgaaggataataagcataaaaaataaagtaatattttatccagagagagtgaaaatcaaagtacatatgtaatacgtatgctcaaaaacatttaccttttgaggagctggagatttttctattttagttttttcctcagggcttaaaggaggggatcgctcctttatctcaggaggcagttcttgatacagtgctgaaattggaaaaaggaattcatgtaatcaaattgaggagcactgctccatgggggaaaaacaacgatggtaggggcaaatatgaaattaaagaaatcgatattcaattccttggtgtaccaataagatacctaaaacttacttgttacggcaatttgcaattttactcattagttatcaaaagaactatgattggaaaattttaatcatctggatttcagaaatgcagaaggtgtcattttcacttattatctggtcagacagatgcttattttattttatctcaatacacatttaccagggacctgctaaatgccaggatatctgctaggaactgttggagaacatatggagatcatcaaaagatagtcttcattagcaaggagcttacagtctggtcagagaaagacatgtttacaagtaaccataaaataaatgtgacattatttgaaagtgaaataattacaaagacaaactctgatgtggggatggaaaatgcttaatggaagaagtggtaggtgtatcagactctgaagactaggtaggattttaccagtcagaggtacgcagaaaaactaatttgggggcagggcgcggtggctcatgccaacactttgggaggccgaggtgggcagatcccttgaggccaagagtttgagaccagcctggccaacatggtgaaaccccatccctacccaaaaatataataattagctgggcatggtggcgtgcacctgtagtcccagctttgggaggctgaggcatgggaattgtttgaacctgagaggtggaggttgcagtgagccaagacagcgccactgcactccagcctgggagacagggcgagactctgtctcaaaaaaaaggaaatgataatttgggaagacgatatgaaatcaataagcatggagttaggactatatatgatattgaatctatatacagtgttgaatttaagattcttacaatccaatattctatataatctattgaatctacatagggtattgaatctaaagagctatgtgcaaattttaaagggttaaaacaaaaatatattttggttaagaacatctctgaactgaaagaaattgctgagatatacttgatcaaaattgtacaactaagattatgagatatactaattgtctttgtatgtggagtgattttattattgggtttatctcatattttgagggtgttagatgtgatgggggaagctgatcatgttgttctttacagtgccttaagatacaaagagagtaagttccttgtaacagtgggagtacgaacttcttttattgtgttgttctcttagaggacaggctctcttagagtatctgcttgtatacttccttagattctgctcttatactcccttagataattcactttgcatagttggcttcagataaagatcaaggacaattcttcctactatttttagactagaatatgctactgacagtcatttttttctctaatgttaaaactgggcaattgagttttttgttaaattcaggtaaaaaaaggataaaagggaaagggaaataacccctaatgaagtgtgagagttcaatcattacagtcgcagatttttctaagttttttttttttgtttgttctggtctatacaaggctttttaaagcagtgactgatgccaaaagaaaacataaattattctgggatacaataaggaattatggcagttgaaagatggtcatcattgagacaaagaatttatttctgtacgtagccatcaactcatcactgcaatatgcttcagaggtctggctttgatcatcatggaagaagaacaaattttattagcttttaaaaaaaatttatcttttgtggagatggagtcttgttatattgcccaggctggtctcaaactcttggcgtcaagtgatcctccctcttcagcctcctgaagtgttgggattacaggtatgagctgctgcatctggcctcattagctttttaattcactgtagctcaaatatctatatcctctcaagatctgcaagcctaagaggttatttttgtaaactacattctcaaattaaagcacttaatcccaccctgcctagagatacacaagggagaaaatttaaaaaatatttccatttgtacatgaaaagagtaatggattgtaatatttcgttaaaatgaggcatactccagagtgactaccattgtgccagcagctcttgatttaaaaagcttgatttaaacagaagctactcctgtttaacctcagctgttgaccctgtgggagacccaacaatgagaagaaggaacttggctattttagatgatctggaagttagaagtgctgagcttatggaacttatatgctgtcttatacctacatgggaattaacttgccctaaaatttcttcctttcatacggcctatgttttttccattacacaacctcttctaaacacaaaaatatacctctaacagagtttaagagttatgtgtcaaaatcagctgggcatggtagcatgcccctgtagttccagctactcaggaggctgagatgggaggactgcttgagcccgggaggtcaaggctttagtgagccgtgactgcatcactgcactctagcctgggtgacaaagtgaggccccgtctcagaaaaaaaagaaagaaagaaaaaaaaagttatatgtcattcactacttacaagaaggtaactaaaacagctacacagaagacattaagaattttatgagagtgagaagtggtacaatttttgagacacatagaactttttaggggaggagtctgctgactgtggcagataaactgaagaagggagctgcaatgggacttagggcacttgagagactggggaggggagcaatgggaaggacctggctgaagacaaggtcgtgggaaggtgccaaagacagataattttatctaggcttagcccagcatccggtaatcacgaaggaaattcttccattccttcatctctttggctgtcaaaattgaaaacttaggttagaatcaataatatttttgtttagtcgtagttttgggttaaacagtttcatggactagcctgaaaaccaattattatttataataattatttctttgcagaaacaaaagacttaaatattcaaaacacagattgttctcaatttcaaggctgcctatactacaacttttttttcttttttttgagacagagttttgctctgttgctgggctggagtgcagtggcacgatcttggctcactgcaacctctgcctcccgggttcacgcgattctcccgcctcagcctcccaagtagctgggattataggtgcccaccaccacgcctggctcattttttgtattgttagtagagacaaggttttgccatgttggccaggctggtctcgaactcctgacctaaagtgatctgcctgcctcggcctcccaaagtgctgggattacaggcgtgagccacagtgcctggcccgcctatactacattttgaatcagaaccagaatttttgtgcttacagaagaaaagcttacagataatatcatttaattccttcattttacagaaggtaactggggcgtatgagtgtaagatgttgagctgaggttagaagtcagttttcctgacccctgagtgttgtgcttttcctagcatgctatcaagttaattgtggatagaatgcattcttctcaagaagcactactgtacttctcccctttaatgacagttttaagttattattatttttgttttcaggctctctgcgttcgttctgttttcacctctcaaggcctagtggtgaatctacagctttcagaaactcatatttagattttcttccctagctcttttttttttcattttaagctattatttaatgaacaaaaaccattattaaaacacgaagtagaaattaaaatacaagaaaggttcatacagtcttgtcacatcacatggtaagttctaggctttgtcaacacgtgcacataacttttaaataattgtcatttatcaactttgtgcttacatattttcagctctggctcattttttcccccataaatgagggctaaatttacttgagaatgaaacaacttattgtagttttgttttcacaggtaaccagataggactgaggtatacaaagtaaaagaatgcagttggggaactagaagctcttaagatgccagtcagctgaggaggcactgtggctagagaagaactgacagaactgtgcatgaggcaggtggcagggtcaaatgagttgaataagaaagctggtagctagaggggcagggtccccgaggataagaagtccatgaaacaaacattccaatctcagaatggagcagcttctaatgtactagtgcctcctctttttatttttttacatcatgagaatgaaaaacaatacccattggtaaacatatgcaaaggttacaaagacagtaaattaaagactagaaaatgataaaatcttggactatcagttataccatactagtaaaccaggaagggagcataaaacttactttcactagccacatgattagctggaaaataaccttcctgtccctttcctatgctgccataccaccagtcttcattatctttgaaaaacactcggataatgtctccgcgatggatggttagttcatctgatcgattcgctgtgtagtcataaagagccactacctaagagagagataagaccaccacagctttatcacaactgtaccacagagaaaacccccaacattcacttcctcttgcagaagagcagctgaaaccaaagcagtactttggtaagtgtgaggctgtctcaaggtttgctaatgggatgaggggtggtgggaacacagcaggagaagcaagataaaagactgtgggattgagaaatggttacgagcattcaatacactaagattagcttcaaaatagcagatgttaattttttaaagtaaattacttgtgaagcaaataaaaaaaagctcacacaccatttacttttttagaattgttttatactacctttatgtctcattctctgtgctaagcagatgcatctgaaaaaaaattcttcagaaggtctacagttttacaaaaaggaaaaactcaatggaacaatctgattgtattgcttggtttactgttaatgtctttttttgagataaatttctctacacacatacatattttttgatgttttatatcaacaacttaagccttctatctttaaaaagtatccatataagttatttttacttgatacgaatttaagaggaaaagccttttcatgagaatcctcttctttgtgttacaataatcattatatttgacttccttttcttttgaaaacccaagtcaaaatgatatggcagtggctgcacaggcatttaaaaatccttggctgggcatggtggctcatgcctgtagtctcagcactttgggaggccgaggcaggaggactgcttgaagccaagagttagagatcaacctgagcaacaaagccagacctccatctctatataaaaaaacaacaaaaaaaattagttggctgtggtagtgtgtgcctgcagtcctagcactcaggaggctgaggtgggaggatcacttgagccccagggtttggaggctgcagtgagctatgactgcactactacacttcagcctgggtgacgcaggaagaccttgtctctaaaaaaaaagaagaagaaaaaaatcccttatagtagttaaaggcaggaagacctcaattcattttagatttagatctgatacactgtataaagtaggacataataacatctatactaaataatacatttatgctgttttcccctctacttaaacagtatctgaaaatgtataggttatacaactacatatgtaatggaaaattacatatatagttatatatacatatatatatatatatatatatttatagcatgtctcagtgtgcacagcacgtgagagtccagggaagagaaacctaagagtcccatgtggtgggaacccggcattagacgtgagagctgagatagaaggttaggagaagctgaggctcatggagtaagcagggctcagatcatgcatgttgataaagttcagactcaataatatggccaatggaaaggcacagaaaggttttaaccagaggattccattacagttcacataactgtttctgataccttttaatccatttaacaatatttattaacacatcaggcaattctaacgaatgagtttggacttaactgctgtcaccatataagggcagtaatgataatttaattcaactggctcaaatgcaatgcctattgtacagcttagcatagtatctaatttacaacatgcgatgcagggtgttatttaaggtttacaaattacaatttttttttttttttttgagatggagtctggctctgtcgcccaggctggagtgcactggtgtgatctacactcactgcaacctccgccacccgggttcaagcgattctcctgcctcagcctcctgagtagttgggattacaggcgcccaccaccgcgcctggctaatttttgtatttttagtagagacggggtttctccatgttggtcaggttggtttcgaactcctgacctcaggtgatctgctcgccttggcctcccaaagtgctgggattacaggcgtgagccactgcgtccggccacaagttataattttagtatactgatgttaagtcacttacatacaagcggaactttaacttttctctttgttctccaaatttctctttcagtctcttacctggtactatcataggagaggaaagctaattaaaatgtgctgagtgctcaccatgttctcgataccatgctagctgtttaggtgttattctgcttaatccttatgacaacttggtcaggccatgtatctttatttccattttacaaaagaggtatttgatgtccagagaaatttaggaacttctctaaagtcaagtaaactagtaagtgatagaatcaagacttaaacccagtctcaatctctttccttccttcccttctttctttctcttcccctagttccaggaaactctgtgatggtttgttcctgttgttccttatcctgggtgtggtacaaaacacaactttaatgagtctcatgcaaagatgagattaatgtatgcttatttgtctggagccctaggtggctgctgggaaggattcagcttaggcaacagaatcacttacgaaatcctacatcaggctgtgtcactgtgtgaacctcggaaagtctgaagcttatcaagtgaagtctgaaaaattttcctgaattttacacacaggggtgtcttgataaaagaatcccttcagaggcacaggggtccaaaaagcctatgagagcccacattacaccttttctattacagtacctactgattattctcttacagaaccaaatacacacatcaattttgcatggcccactagtatctgtaaacatgttctgcattctgtgactgttatggactgaattgtgtcactcaaaattcataggttgaagtcctagctcccaatgtgaatgtatttgaagacatggcctttacggaggtaattcatgttaaatgaaatcataggggtggggcctggattaacaggactggcatttttataagaggaagatacagtgagaaagtggccatctgcaagccagcaggagaggcagtaggagaaaccgactgtgctagcaccttgatcttggtcttctagcctccagaattgtgagaaaataaatttcttcttcttcttcttttttaaaaaaattatttcaatagctttaggggtacaagtggtttctggttacatggatgaattgtacagtggtgaagtctgggctttcagtgtacctgtcatgtaaatagtatacactgtaccccacaggtaatttttttttttttgagacagagtcttgctctcttgcccaggctggagtgcagtggcgccatctcggctcactgcaacctctgcctcccgggttcaagctattctcctgccttggcctcctgagtagctgggattacaggcacccgccaccatgctcagccaatttttgtatttgaggtagagatggggtttcaccacgttggccaggctgtctcaaactcctgacctcaggtgatccgcctgccttggcctcccaaagtgctgggattacagacgtgaaccactgcacctggcccccgacaggtaatttttcattcttcatccctctcccaccctccttccactcttctgactctccaatgtccattatacctctctgtatgcctttgtgtagcttagctcctacttttaagtgagaacacgtagtatttggttttttgttcgtgagttacttcacttaggataatggtcccattcccatacaggttgctgcaaaatacattatttcatactttttaaaatggatgagtagcagtcgacatacatatacataacacactgagaaaataaatttctgcaaaaccacccagtctgtggtattttgttagggcagccctagcaggctagtacacttttaaacctgatggtgtcagatgaaccacttactaccaccccagcctaaaactacaaatgtgtaatgcctcacttgtatccatttcaggtcctcagcaacttacagaaccgttttccacactattaagctgtcatctccggatgtagaaatgtctttgtcataaaactctacaaccagcatccttgggagggtgatgactggtgaggctacgttctctaaagcaaagaaattggagcatgtcatcgtaataccattgttgacattcaagtacacgcagacctcattttattgtatttcacagtgtggtgttataatatgtattatgtttctgtttgcaggtcctggttcataactcccatatcccttgttacagttttttggtttaatggtgggtatgttaggccttaggggcaggcctcagaaaacagaatgtctctgatctccttctgctctccttttacctgccccaaggtagggctctaatcaccaccccctacctttctgactgtaggtcttatgagcaatcagagggtccttcccccctctaccctggaggaaggaatgctgatgtcgcggagcttccacaaaaacctaagaggactgggttagcagagcttccaaatagctgaacaaatggaggttccaggagagtcatgccccagggaggtcaaagaagcttcccctccttccttcatagatcgctctacgtatctcttcatctgtttcctttgcaacatgccttgtaataaatcagtaaatataagtaagtgtttccctgagttccatgagttactccagcaaattaagtgaactggaagagggggttgtgggaaccccaacttgaagccggttggtcaaaagttctggaagcctgtacttgtgaatggtgcctggggtggggggcagtcttggggactgagccctcaacctgtgggatccgacactgtcttcaagtagagggtactagaattgaattggagtacatctagctggtcatggaagtcttctgtgttaattgtggtgtgagaacacagtgaaaacatggttggaaagtttttcccaaacatgtagatactgcatttttttgccaactgaaggtttgtggcaaccctgcattgagcaagtctatcaaggccatttttttccaacagcatgtgcttacttgtgtctgtgtgtcatattctggtaattcttacaacagttcaaatttttcctttattattatatctgttatggtgatctatgataggtgatctttgatgctaccaatgtaattcttttggggtgccataaaccatagccatagaagacaataacttaattgataaatgttgtgtatgttttgattgcttcaccaaccaacctccaccctcttaccccctaccaccaggtctctctccccttctccttgggcttcctattccctgagatataatggtattgaaattaggccaattaataactctataatggcccctaagtgttcaaatgaaaagagttgcaagtccttcattttaaataaaaaactagaaatgattaagtttagtgaggaagggatgtagaaagctgatagaagcaaaaaactggcattttgtgccaaacagtcaagttatgaatacaaaggaaaagttcttgaaggaaattaaaagtgctactccagtgaacacatgaatgataagaaagcaaaacagccttattgctgatatggaagttttagtggtctggatagaagatcaaacaagccacaacattctcttaagccaaaatccaattcagagcaaagccttaactctcttcaattctatgaaggctgagaaacgtgaggaagctacagaagaaaagttggaagctagcagaggttgcttcatgaagtgtgaagaaagaagccatctccgtaacataaaagtgcaaggtgaagctgcaagtgctgaggtacaagctgcagcaagttatccagctctaggtaagatcactaatgaaggtggctatactaaagaatagattttctcaatggagatttaaacagacttatattggaagaagatgccgtctatgactttcatagctagagaggagaagtcaatgactggcttaaaagcttcaaagaacaggctgactctcctgctaggaactaatacagctggtgacttcaagttgaagccagtgttcatttgccatttcaaaaatcccagagcccttaagaattatgttaaatctactctgtctctcctctataaatggaagaacaaatctagatgatagcccatccatctacagcacagtttaatgaatattttaagccctactgctttgtgaccttctgctcagaaaaaaagattcctttcaaaatattacttctcactggtctaccaaagagctctgatggagatgcacaaggagataaatgttgttttcatgccagctacaacaacaaccattctgcagcccatggatcaaggagtagttttgactttcaggttttgttatttaagaaatgtatttcttaagtccatagctgacatagacagtgattcctctgatgaatacgagcaagtaagttgaaaaccttctggaaaggatgcactattctagatgacattaagaagatttgtgattcataggaggacatccaattgtcaacattaacaggggtgtggaaggtttattctgaccctcatggatgactctgagggttttaagacttcagtggaggaagtaactggagatttggtggaaacagcaagaaaactagaattagaagtggagcctgaacacgtgactgaattgctgcaatctcatgataaaacgaatggataaagagttctttcttatggatgaacaaagaaagtggtttcttcagatggaatctactcctcgtgaagatgctgtgactcttgctgaaataacagaggatttagaatatcacataaatttagttgataaagcagcagcagggtttgagagtactgaatccaattctcaaagttttactttgggtaaaatgctatcagacagcactacatgctacagagaaatcttttgtgaaaggaagagtcaatcgatgtggcaaatttcatttttgtcttattttaagaaattgccacagtcaccacaaccttcagcaactatcagtctggtcagtcagctgccatcaacactgaggcaagacctgcctccagtaaaaagatgacttgctgaaggctgagatgatcattggtattttttagcaatcaagtatttttttcactaacgtatgtacactgatcatttagacatggtgctactacatacttaatagactacagtaaacatagttttaaacatagttttctatgtactgagaaacccccaaatttgtgtggcttgtttcactgtgatattcacggtattgcagtggtctggaaccaaaccggcaatatcttcaaggtatgactgtacagaattgctacgcaatgaggaatcagggtggtttcacatgctaccatctgtccacatgccggcagccgaatctaaccattcagttaggattattcccttaacacactgaaggacaaaaacagcgtggctcacgggaatctgcttgtatttcagcgtttttatccaatgtgctgtgaacttctcatatgaagatcacttactgtcttctgatcatcatattgtatgtagtaaacttctttgcttgtgttaatttggcagtggattgtgagtaaatcataacttccctatgtccaattagattttattatttcaatattttataataaattaaagttctataaagcagttaggtggcacagtcctatccagaggtttgttctgaagtaacagtctattttctccttgttcagtcaggcatcactatagaaatatctttcttgaccattcttttgatgagtgtcttttataacataccatttcttgcaccctgtggtttggcatgtaggagaatatcttcagcaatatgactcaaatcttgagctgacagagtaattaagaaatctttctgtgacagaagtttaaagacacgagctaatatgtccatcttggtaatgacaggactagaaaaagagatgtttcacaaaatccacgtggtcaaattttgaccactgttcacatatttgaaatagagttcttctttttctcaaagcttgaggggttgcttggtcataatcatggtctcagtgtcactggattggcaagttttgtttttttgacacactattttcactcttttccagcactgctggaaacaccatttcttgatttaggcagagtctgccaggctgttgtaagacattaggggaattcctttctgtattatctttcaagggattaaatattattatagtggtctctgaagaattctcagtgacgcctggtcaatgaaaccagtgtactgagggaacaccaaccagtagagttcagcagcatagctgttccttacagttttatccacaatgcaatccaataattgatgttcgtaatacctccaagtcattcgacaagctaagcactgaataaattcacacgcttgagcactttttccttcagccctacttcaattgggcccataatcatttgggaacttctctgtgccagtctaataaggcaatatggcatctggatcccaccaccttctttatgctttctccttgactaacctgatttcagactccgggcttccagaactgtgaatgaataaatgtcttaggttttaagccaccaagtttgtggtagtttgctacaacagccctaggaaactaatagacacgatttttactttggtgagtgctggattttcttctatttctttaaagagtgttggaccttggtctggcatgccattacttgatatccgttttcaggtttaggtttttttttttttttttcagacggagtctcactctgtcacccaggctggagtgcagtggtgcagtcttggctcactgcaacctccgtctcccgggttcaagcgattttcctgcctcagcctcctgagtagctgggattacaggcgtgcaccactatgcccagctaatttttgtatttttagtagagatggggtttcaccacgttggtcaggctggtctcgatctcctgacctcgtgatctgcctgcctcggcttccaaagtgttgggattacaggcgtaagccaccgctcctggcccaggtttaggttttgatagagcatattcagagaagactttactctagggataaattaaccccactatcaaggtgtgaccttcctgatgattctacctgatgccccaggtatattgaatattgaataaaaattacaagccattggactaagctcctgaactaggccccaacagaccagactaacaatcaaaatgaagtcactcgtgctgaagttctatgtcatcaaaccaaaactaacttgttaattcaccttccaagaaattgggagagaaagagagccaacttcccaaacaggccagtttaaatttccaaccagtatggtaatgaagctccctctgttttaatcttgacaacaaaaagtaacctgaagttaaccagttattcttctgttattctgttttccttttcctgatatacaaggaaaggaactttaaaaaaccaatctgctctttattctttgtttctccccccgttccttctctgtctataaaaccaacttcttttgctcagctcactggaacatatattctattttatggaatgaaatgctgccccattctggcaaataagccaattaagatctttaaatgtattataattttgtcttctgacagaaggtttatcattctggctatcagaaatgcgaatttttgccatcctgttgttgtgtcttctactctctgatggtccttttcttacgaagttttgctccacacatgtgcagatcagcactcagccaaagacttcagggtactccttaggattactggtacaattattaccatttaatatagagccaaatataaagtaatattttagtaattatttaaaaagtgaaataaaatacgctttaagaaagtctcatttctcaataatgtcaaagataaaaaatatttgtagaaaaccaaatttaacaataaatcctgaattgtacagaagcacattattaaatattaaaatgcttcctttactaatagtgacactaggactatattttatttcataagaggaataaagaaacatatagccctatttctagcatcatgtggtagaaacatacagtcccttaccattatatccagggacaaccctaaagatatttataaaaaagaaatcaaggtcctattatttttaactgatcttatctggataataatagattaagaaaacaaagataaagaaagtaaataattgcacacagtttattgcctctgtatcagataaatgatctgttcctatcttgctgtataatgcaacgataagtgaaacttaaaaacttcaaacaagcatttgaaagcatttaattccagatatcttctgataaaataatgactaaaggtgttggaaagaataccaaactagaaatcaagagaatgagtttccagtcctgtgtaggcctccaaggtttaagtactcagattatatatctgtaaaataagaggtctagacaagatgatatatggtataccttccagctttaaaattttaccaaactaagtactcaattatatcaaaagaacagcattcatagattttaaggtaaattgaaaatattaatttattggataacatcatagctttattgtttgtgatcacacattaactgaaaaagcttttgtctgattgctgcaataatatataggaaaagcctcttagtaatattagacaacaataacgataaagcatttcctctgaattcaccatttggaaatacttttcttattctttgacaaatagggatgactttccaagttagactgaacttgacctttgggcttcaaaaataaagctactttacatgtgaaagctcatttttatatgatggtgatatcatctgaatgtttgtgcccctcaaattcatatgttgaaacttaatcatcgatgtgatgatggggcctttgggaggtgattaggtcatgaaggcaggaatggaattaaagcccttacaaaagaaaccccagagagcttccctgccctttccacttgtgaagacacagcatgatgatgtcatctatgaaccaggaaatgagccctcatcagacatcaaatctgccagtcccttgagcttggacttcccagtctccagaaatgtgagaaataaacttcagtcatttataagtcactcggtctatggtattttgttacagcagcccaaacagactaagacaattggtatgaattaaaccttttcttactgcgaatcacaattcacatactttattataagaaataatcggtattacattgaaaaagtttctaaaataacatctttttattggctattccctaaaaataaatcaagagaattctgcagacctttatacattggactacagatttgttaagagaagaaaaaatcatagtgtattttcattttctttcttgggagggataatctgctcactataaaaagaaaattatgaatcactgatttagattagggttctcaaaacgtattccccagacctgcagcagcaacatcacctggaaacttgttagaaatgtaaattcttgggccctattccaaatcaagtgcatcataaattctggggatggcccagtaatctgtgttttagcaagtctttcagcaattctgatgtacctaacgtttagttaatactttattttactggtctactttataagacatatatacttatttctgcacatatcaagtagtaactgaatgggtaagaaagataatttaaaatataaagtcgaatcttagaatgttactggccaaacttacgaaattaacctactcttgctttctgagttattagctttacttatcttgcttagtttcccacatgtcacactgaaatgctcactagctccagatttggtcaatttaacatctactttgtcattttttttcaacaatcttatgctcaaactgcaactaggagtatagtatataatttttaggtttccttacaatctcttaaagattagccaaattttaaaatagaaaaatatgcaaactttaaaaattgaatctgttcatccaacaacaatcatcagttacctattatcaaatctcttacaggctaaggagagaataatgaataaaagaaatttaaaaaaaaaaaccactctcagagagcttccattttttgggatgttacattgtatttggtttggtattccttttcaaaaaaaagggtacctctaacatttgtacaagttactcttctgtttttctacttttatgttgctaataaatagtaccaaggtgcatgcagatatataatattaaaataataatttgtgcatgaattatttcagaaaagtataatgaattattttaaattctcttaatgaactgtaagctgtaagcaaatgtaaaattactagtaatagacacagacaatatttttaaatgagaataaatccaagtatttgtaaataacatcctactcatgatttacagatacagtttcattagttataaaacattttagaaatatataaacaggaccggcgtggtggctcacgcctgtaatcccaacctaggtgggtggatcacctgaggtcaggagtttgagaccagcctggccaacatggtgaaaccccatctctactaaaaatagaaaaattagctgggcgtggtggagcacgcctgtagtcccagctactcaggaggctgaggcaggagaatcacttgaacccaggaggcagaggttgtagtgagccaagatcgcaccactgcactgcaccctggatgactagagcgaaactccgtctaaaaaaaaaaaaaaaaaaaaaaaattccatatttataaatacagacatacactacataataacatttcagtcaatgacgtactgcatatatgacagtggtcccatatgataatggagctgaaaaattcctattgccttcttacattatagctgtcataatgtcacagcacaattaatttttaaataaatttagtgtagcctgggctgggggtggtggctcacacttgtaaatcccagcactctgggaggctgaggtgggcggatcgcttgagtccaggagttcgagacaagcctagacaacatggtgaaaccctgtctctactaaaaatacaaaaattaaccaggcatggtgatgcatgcctgtagtcccagctacttgggaggctgaggcaggaggatagcttgagccctggaagtcgaggctgcagtgagctgagatcatgccactgcactccagcctagatgacaaagtgagaccctgcctttacaataatctcctgtatcttatgagatattctgtttcttaaacatctcatttagatgctttaattttattcaaccaaggttttagaactcattagctctaaaacaatcatacagacctcagttgggttttctctcagcattgatgttcatttactgttactattaatcatctgatacattatagacatgcctgtgtatctgtctagatatatttaggaatataggtatctaccatttacttaatgcttgctatgtgtcaggaaggtgttaaccattttatactatacatatatgtgtgtgcacatatacacacacacatacacatatattcataactaccccatttagtatttatcatgccttagtttccttaactataaactaaaataactgttatttttaagttacacagtttagcagaatagagatgtaagcaagtctgcttttctcccacgtctatgctcttcttaatcactagacttacattataagccctcatggaaccatgggaacacaaacctgcttggttcactgcttgtcactttccttaaaattatgccaaaaaaaaagggtcttaaagacttggcatttctttattaataatgaagacacctgaagaagatcaacaaagtacttttcttcatactaatttctcactcacaatttgttgaggccaccaaacaagcaagctacatgggaaattgaaattagaccaaggtggcagcatacatgtaccacatacacatatatgtatatattaacatacatacatatgtacacattaacatttctgtccatttggttactgaagttggtatttagggtgcaggaaattactaaaatgatagaagaaagttactgtggaaaggctgtgaagaggccaagtgcagtggctcatgcctgtaatctcagcactttgggaggtcaaggagggaggatcacctgagcccaggagtttgagaccaacctgggcaacaaagtgagacccctatctctacaaaaaaattaaaaaaatcagctaggtgtggtggtgtgcatctgcagtcccagctactcaggaggctgaggtaggaggactgcttgaacccaggaggtcaaggctgcagtgagccgtgatgatgttgctactgcactccagcctgggttacagagtgagattctgtctcaaaaagaaaaaaaaaaaaaaaaggctgtgaagaaatcttgagtactaaaattaaatgagaaagaggatagccagatatcagtaattaactgcttattttactaaaataccgaggcttatctaattccaaagtcaatccaaatattctaggagaagttcgcgtacatgcatatgagcatttggtttatggggaagaagataaggatataataagagaaaggataatgaagaagcatagtagaaaacatccctggctgggcgcggtggctcacgcctgtaatcccagcactttcggaggccgaggtgggtggatcacctgaggtcaggagttcgagaccagcctggccaacgtggtgaagccctgtctctactaataatacaaaaaaaattagccggcatggtggcgcacacctgtaatcccagctactcgggaagctgaggcaggagaatcacttgaacctgggaggcggaggttgcagtgagctgagatcgcaccactgaactccagcctgggtgacaagggtgaaactccatctcaaaaaaaaaaaaaaaaaaagaaagaaaaagaaaagagaaatatccctgcgttagcacgttagcatataattctaattgtgatacataaggaaatgtagacagttgattaggggactctaaaacttatcaaaaagcattttcaatggctaaatagaaagtagcaaatagaatcttcagaaacaaatggaaaactctgagcttaaggataaatgagtaaaggggaatcacttccagaacagtgaagcagtgaaatgggctcctccaacaatgcaagaacactgggattaactgtcaaaatcaactttatcagaactctgaaaactaactaaaggcttgcaataatctcaggagtgtgattttaagaataacagccaaataacagtaaaaacagcaagctttgtggaattttaattttctctattcttatcatccccttgccaactccgtggtatccttacaagtcaacaatctcacaactatggctgctgtgaaaactagcagcctagcagttactagacagggcagaatgggtctggagcacctctaaaacccaatcgcaaagaaatgtcactttatgacctgtgtagcagctccctgaaaagctccattcccagagctcatctttccttttttttttttttttgagacccagagtctcactctgttgcccagactggagcgcagtggtgcaatctcggctcactgcaacctctgcctaccgggttcaagtgatcctcctgcctcagcctcccaagtagctgggattacagatgcccaccaccatgtcccagggctcatctttttaagatgtgactcacagcatgctgtgaatgattatatccctagggcatttgtcaaaagcaattaatggtaactgtttaacactgcacctgccttaggtggtgatatgagttaggactagagaaattaatttccagtttgccacattatataatctcaaatatcctcttatcaaaaaattacgaaacatgcaaggaaagaggaaagtatgtctccatatggaggcaaaatagttaacagaattgcttctgagaaagcccagatgttggacttactagacaaatattttaaatactattataagtatgttcaaagacctaaaggaaaccttgtctaaagaattaagagaaagtatacatgtacctcaccaaacaaacaaacaaaaaatcaatatagagatataattttaaaaaacaagtgaaattctgcagttgaaaagaacaatattcactagagggactcaatagtaggtataaactggcagaagaatcagtaaacttgaagataagtaaattgagatgatttagtctgaggaacagaaggaaaatagaatgaacaaaaatgaacagagcctcagagaattataggatgccatcaaatgtaccaacatatgcataacaggactcccagaagaagagtcagagaaaggggaaaaatgaccccaaacttcccaaagttgatggaaaacattaatctgcacattgacaagctaaatcaactccaagtagaatagattaaaaaagatccatatctagacaaatcatggtcaaatgactgaaggccaaagataggatctcaaaagcaacaagaataaaaaactcatcacacagaagtgattctcaataagattaacagtagatatctcataaaaaaatgtgaaggccagaagttagcgggatgatgcttttgatattgtgttgaaagcagactcaaccaagagttcaaaccatccagcaaaacactcctttaaaaaaagaaaaaaggaaggggccaggtgccgtggctcacgcctgtaatcccagaactttgggaggctgaggcgggtggatcatgaggtcaggagttcaagaccagcctgaccaacacggtgaaaccctgtatctactaaaaatacaaaaaaattagctgggcgtggtggcacatgcctgtaatctcagctactgaggaggctgaggcaggcgaattgcctgaacctgggaggtggaggttgcggtaagctgagatcgcaccgtgcactccatcctgggcgacagagcgagactctgtctcaaaaaacaaaaaccaaaacaaaaacaaacaaaaaaaaaaggaaggataagcagtgtcctgggttactgaaaaaataaattaaaaaaaggtgaaataaatacattgcaagataactgataattcagagagtttgttgcttgtggacctgcccttcaagaaaaacagaagtccttcggactgaaatgaaagagcactgacagtaactaaaatccatttaaagaaataaagaacactgataaaggtaactacacaaaatataaaaaccagtacatatatatacatacatacatatatatatatatatatatatatatatatatatatatgtttttgtttgtaattcttttctctccatctaattaaaaaaaactttgtaaagaaatagttataaaaataagttggtgggcttaaaatgtataaagatgtaatttgtataaaaccagcacaaaggaggcagaagggaaatgaactatcttggagcaaagtttttatatactactgaaattaacttggtattaatccaaactagattgttttgagatgttaattgtaattctaagggcaaacactgaaaaaactcaagaaaatatactaaagggaaaagaaaattaaaattatatagtaaaaaaatactaatttaatgcccaaaagtgagtaacggtgaaacaaaggaaaaacaacaacgataatatatcagacatataaaactccaaaaccaaattgtagacatcatcctatcttatcagtaatttcactaagtgtaaatagattaaacactccaaataaaaagcagagattatcagaatggataaaataaataatccaattacaagctatgtacaagaacacttcagatttaaggatacaagactgttgaaaaatggaaaaagacataccatgcaaatggaaatcaaaagagaactggagtggctattctaatatcaggcaaaatagactttaagacaaaaactcactcactagagacaaagaaggacattgtataataataaaagggtcaaccaatcaggaagacttaaaaagtataaacatataagtacatgatacagtctcaaaataaagatcaacataaaaatagaagatttaatcaatgctgtaatagatgtctataggatgcttcacttaacaaaagcagaatacatattcttgtccacagaacattctctaggagacaatatgttaggcccccaaataaaacttatttaaataaataaattttaaaaacctgaaagcacagaaagtatgttctccaaccatgataaactgaaaaagaaatcattcacagaaaatttcataatgtatggaacgtaaacaacatactccaaataaccactgggtccaaaaataaaaccccagggaaattacaagagaataaatgaaaagaaaaacacgataccaatatgtatggggtgtagaaaaagcagtaatttgatgaaattttatagctgtaaatgtttttattaagagaaaaagatatcaagtgaatatttttactctgtaccttaaaattgttaaataaaaattaaacccaaaggaagcagagggaaaaaaatttagagtggaaataaataaaacaacaaatagaaaaagagtagagaaaattagtgaaataaaaattggttcttcgaaagatcaagaaaattgacagagcttcaaatagactggccagggtagaaaaaacaaaaggtaagatccaaattaataaaatcaggaatgaaagaagaagtatcattaactactttagggaaatgaaatggattataaggaaatgaactatcaattgtatgttaacaaatcaaatagcttatatgaaagggacaaaaaaatcctagaaagatgcaacttaaaactgactgaagaagagagaaaatgtgaataggccaataaagagattaaaccagcaatcaaaacactgcccagaatgcatcattggtgaattgtaccaaatgtttaaacaaataccaatccttcacaaacttccctaaaataagatagaaatgaacattttctaattcattccatgggatcggtattaccatgatcccaaaaccagacaagaaaattacagatcaatgtcccttatgaatactgatgcaaaaccctcaaaaatataccaataaacagaatcaacatatgaaaaagattatattatacatcataacaagtgggatttgtcaagggaatgacaggttggcttaacatatgaaaatctaccaatgtaacagaccatattaatagtattaaaggtaagatccacagaacaaactcagtagatatggaaaatcatttaataaaatttaacatcatttcctaagaaaaacactcaacaaaagtaagaacacaaggaaatgtcctcaacctgataatatataataacctgatatatagcctataaaggctatatataggctacacacacacacatacataacagcatagctaatttcataattaatggtaaaagactgacagtttaccttctaagattaggaaaaagacagggacattcataccacttcaacattgtactggaggttctaactggaaaaattaggcaagaaaaaaaaaaggcacccggatcggaaaggagaagtaaaactatctctattagtagagtatgcagacaatctcaaagaactgatccccccaacaaaatctgaaaaaaaacaaaccccagaaaaacctgttagaatatacagattcaaaaaggtctcaggatacatgagcaatatacaaaaaaccacttgtctttctatacccaagcaacaaacatctttacctgagtaatgaacaatctgaacataacaccaattccatttgcaatggcatacaaataaatttaacaaaaaaaatgctgaaaaccacaaaacaccattgaaaaaatttaaacagacctaaataaatggacccatgctaaaagactgggaagacttaatgttttcacaatttaatctatgaattcaatgcaattcccataaaaaattttgcaaaggctgagaaggtgatcataagattcctatggaaatgcaagggatctaaaataaccaaaacaatctcgaaaaagaacaaggttgaaggacacaccctgattttaaaacttctacagatacagtaattaaaaccgtgtaatgctgaccatagaataggcgtgtgtatggatcaatgcaaaaaaattcagactctaaatataaactcttacatttttggtcacctgattttcaacaagggtgccaagaccattaaaaggaaaaaaaaaaaacaccaaaaaacaaactaacaaaaaacccccacttttttcaacaacagctaaatgcgaaagaataaagttggatccttaactcacaccatctacaaaaataaagtcaaactggattacagaccttaaaggtaacagctaaatatataaagccctcataagaaaatctgagagtcaatcttcagatcaggcaatggtttcttagatataacatcataggtataagtgacaaaataaaaaagtaaactaaactttatcaaaatctaaaaaattttgtgtgtcaaaggatatgatcaagaaagagaaaagacaacctacagaatggaagaaaatatttgcaaatcatatacagtcaaccttcggtacccttggaggattggttccaggattccccttggacaacaaaatctgtggatgttcaagtcccttatataaaatagtatttgcatacaacttacacaatcctcccatacactttaatctccagatttataatacctaatacaatgtaaatgctatacaaatagttgttatactatttttattttcaaattgttattttttttcaaatgttttccatttgtagttggctgaatctgtgaatgcagaacctacagacacggagggctaaatgtatctagtaagagacgtgtatccagactatacaaataactcttacaagtcaataataaacaggttaacttaattagctacaaataatataaatatatttacattaaaaatttatatatattttacaaaattttacaatttatttttatatactatataggtatatttatatactatatgcctggtacatattaagtactcaataagagttaggtataattattattaaattcctaagttatttgactattaacaaggaatgatgttttctgcagaatgcctatagctatgtgaccatattttccaaaccaaatatagatttgttaacttcaaaccctccctccctcccttcctccctcccttcctttcttccttccttcttccctccctctctcttccttcctttccttttctttctttttctttctctctctttctttccttttctttctttcccttcctttctcctttcctttctctctctctctctttctttttagaattacaggagaatccataaagtgaaagcaagtttattaggaaagtaaaggaataaagaatggctactccacaggcagagcaagcctacttcaactccatttctgaaaaccaaaaattatttctcagtttattgaaataagctctgattcacacacacacacacacacacacacacacagtatattaaaaaaatctagtatacataattatataacaaaacataattataatctccccaattagaaaatgagcaaagaatttgaattagacatttctccaaagaaaacatacaaatgtcatttcagaagatgctcacattatcgtcactgggaaatgcaaatgaaaatcatgaggtgtcacttcctatccactaggacagctataatacaaaatcagtaacaagttacgatgtggggacactgcaacactcattcatgtctggtgtgatcgtaaagtggttcagttgctttggaaaacattttgacagttcctcagaaggttaaacagagttaccatatgatgcggcaattctactcctaaatatatacacccaagagaatggaaaacttacgtccatgcaaaaacctgtacatgaatgctcacagagtaatattcatggtagctaaaaatggaaacaacccaaatgtccatcagtgaattaatggataaaaaatgtagcatatccatatacttgataatatttttggtcatcaaaaggaatgaaattctgatacatgccacaacatggatgaaccttgaaaacattacggtaagtgaaaaaagacagacacaaaaggctacacagtgcgtttatataaaatatccagaataggcaaacccatagagatggaaagttgattagtagttgttaggggtgaagaaatggaaaggatcattgctaatgagtacgggatttcttctgggggggcaacgaatgttttaaaattagatagaggtgatggctgcaaaactataaatatattaaaacccactgaatggtacactttaaaagggtgcattttatgccatgtgaattatatccaaataaagctgttataaaaaaagaacatcatggaaatgattgttaaaggaagtgtagttggttatgatgaagaaagaaacagtgcaagaaaaaatacacgtaaggagaccatatttctccatgtcagagaagacaaccttgattctggccatggaaatggacaaaagaggtgagactgtggaaatataatcaaaggagaaagcaacatctgtgggatataagagaactagctaagcttaacatattacaccaaagtattgctcataagaccaaacagctggtagtaccaatgacagaaaactaaagtggaaaggcccagtgaaggtcctggggaagacaggagttttactgagctgtgcttatttttatttttatttatttatttattttttgagacggagtctcactttgttgcccaggctggagtgcagtggcgcgatcttggctcactgcaagctccacctcccgggttcacgccattttcctgcctcaccctcccgagtagctgggactacaggtgctcgccaccatgcccggctaattttttttatttttatttttagtagagacggggtctcagtgtgttagccaggctggtctcgatctcctgacctcgtgatctgcccacctcggcatcccaaagtgctgggattacaggcgtgagccatcatgcctggccaagctgtgcttatttttaggttctttaaattaccaagtggtaacagtctaagtatggattataaagattttttttctagtaaaagagaaagaaaagaattaagattagaatatgagctggacagtcattcatgcttgaacatgagctgaaacttaagtgtatacagtgagcttaccaagtaggtctcaaggaagagatgaagcagccccatcacctcattcttgggggatacaaacaatcacctcctcattccttcactccttttcttcaagcagctgtctgtggcatgtgggtagcctagtttgaagtatagcaggtgtttgtaatttcctttctcaaggtcacaggtgactctgccagtgcacttcaaaaaccacagcttctgggcccctttcttcccaccaaaccccaagatccccttctcacatccagattactctgttacttacacatctttaacccactccacagctattagaattgaagtgcccctcttcccaggaaattgactaaggttctatccactagcctcagatcgttatctgtttgaaacttctttgtgggctgatggaatgttttccaagaaatgttttagaaattggctttcttagataatttccatggtggatttattaagaaggaggaaatcaaggtcatctgttctttttagctgccattctggtcagcctttccagtggtgcctgttgtctccaaccttcattatcacattccctgcctaatcccattgaaagttacagttatattacaaagatcagatgagataatatatagtatgtagcagggcttttaaaaatatacattgtttcatacatgttaactgctgttaatactacctaaactgctctcaattttcacaaaatttgccttgtgccactgaatgacattagagtttaatggtttattcagataaactgattctgcttttagagagttaatatttttggctcatttatcataatgaattaacatattaaatctaaatggttctagaagacgcttgaagaccttttttctgttttccctttggcaaacggtgatgataataataatttatctcatagaattattatgacattcaagtgagattatctgctttgcacagtgcatagtaggtgcccaataaatgttaggtacaattattattcaattcctgaagttcttcaaattatcatagaggaaaggtgttttgtagcgaaatatttctgtagaacacccacagctataaatgtgatcatattttctaaatcaaatgcagatcgactaactggaattcctctgctgaaaaccaggatttattttcagatttggtaaaataagctctgaagccaaaaagtactcccagagaagtctgcatatgttgccataagatagtgccagccagagagattctgacaagaaaactttatgaagtttgatttaaactacagaataagaagggttttttccccctctacggatttattttacttaatctttatgcatctagctaatctgtgacccaattatgtagttataccaagggtgtctgtgttagtgacggccgtgtggctatctctgtcaaagactaatctcactgctggggacactgagatgacaggatagagtatcacaagaagatgaaacttggtgaactcacatgtttatcacggtaaaaaaacaatctatggaacattagtagtggcagatggtagatgtccatctaggcaggaaaaccagggtactagcagtttgataacctttgattaaatttctccccaaatggaaagtaatgctccataataatgtgtgttaaattttttcttttccaaataattgtttccttcatttcatagcctgttaactcaaggtttgcttcctgctagtgactatattactgcttccttagagtggttaaattttattttccttttggtaaaggaaaattttaagtaaccactatatcttattttaaaggcatgcagtaaatgctttgttaaagcacaataaacactgaaattactattaagtagtaacactcctcatgcaaaattacttaaaaataaaaacttaaattgcctgcaggaaaaaaaattgttgccattttgattttgtgcactgtttaacatttttctcatgtttttgaataaagaaaacttgtatgaggcattataaaactcgttaatgctacaaagtttggaaggcagctattaacacagttgaaaaaatcaagattcaaaagaattttgacaagcagggtagcgagtcaaaaatgaatctatgaaattcagtaaaaagaaatggacaacattgcagttagggttaaatagtaatagctaatggccgagagattactgtgtgttagacacagtatttagtacttgaaacaatagaataatattaataaggcagacactattatcatcttctttccagatataaggatggtatgaggcacaaatatataaataatgagaagacttgtctcaacaacatatctttaaaacatcaaggagttatgttcaataacaaacaaaatatccagataatagaaaccaataatacctagtcttgaactcctgggctcaagtgatccttctgcctcagcctccagagtggctgggacaacaggtgcgtggcactgcacctagctaatttaaaaaaaatgtttttaagagatgggttcttgctatgttgtccaggccagtcttgaactcttggcctcaagcgatcctcccgcctcagcctctcaaagtgctggcaggcatgcgccaccacacctgccccttttcttatattagaaaaaatagtgagaatttatgaaatgaagaaaaaagattactgggtgttcattcaatagaacactaggcagcctgaccagtgccctccctctttcacgctatatactacacgtgttctccaacccatctgctggctaaattgcacagatatctggatcccacatcccactgcttagcattgtttatcaagcactgagtttatgaaggtggagagactgggccctatagtgaagagacttagattctgatctactgacaacaactaacctatgcccacttattaagcggcatgaagttttcaacaaaaatggtggtgggtgttaactgccacattataacataaggaagtgaattctaactgaatcctaagaataaataaaatgataagtgagcattcaaaggatcaccactagagatgtgcttcatttttctgctctaatatattgtctttgagcaataagagcagctgaaaaagatgcatagaactttagacccaaaagttgactttaagatcaattttttcaacttttgtcattctagcaattagaaaagtaagtcccttggcaagagaccttgccacaactgacctactctactcctttgtcaaatgctaaaacccagtttgcatctttctcctgcctcattcatattgctggatctttccttccatctgagaaatatttattttgaatggaatactgttgtataattacccaaactgtacttttcactttcacagaacaaggaaaaagaaatctttatttcacattctatataggtttatctcatggcagtccttttggcaaaatgctttcttttctgaaataagtcagtaacatatccacagggctaaattaattgctattctattttccatctcctctcatgacaagcctcttcaattgcttctgattcatcatgcctcctagtgtgaccatccagcttcctttctgggccctgttctcattctcccagagacagcataaaaacacactccatttccatacttgcattggtttccgagatgctacattatccctgatctcctgcctccctttctaccatttgtcttctttgagggctcttcttccagctttcaaaatatgaacatacatctaggccggctctctgttcttacttattcttacagtttcatcatatatacatttattcatttaagcagtatctactgaaggcctataagtagtggtgagtaagatggacatagtccatgctgttatggaacttacatccagttaaggaagaccagataagaaaataaataaaaaattccaaattgggataactgctaaggaaaaaaaagaaagtgtaataataaagactaatgggggtgaaggaaggtcttttgaaaagttaacatttacctgggatctcaagaaaaggcctattatgcaaaaggttgtgtatattcaggggcagagagatcaaatgttcgaaggtctttgggtgagtgggagaaaggttggttgtgttcaagaaactcagaacagagagtaccataggatgatgctgaagagacagacagacagcagatcatgcaaagccctataggccctaggaaagggtttgggttttatcctaaacataaggagaagttactgagggtgtaaagcaggaggttatcccattctgacttatagatcactttggctatcatgacttacagaactgatgaataaggtgatcatatatttagggttgcccgagatagtcccagttcatgcctattgtcctggcataactgaacttctgcattgatttcagggaagagtcacaatatgcaataaacaaatacatacataaataaaacaaaaaacaaaaaaaacaaaaaaaaaaaaagaaagaaaattgactaagacacaaacaagctgtgggaggcaacattcatcaggtttccttgttcctgatctccttgacctaactgggatccttccttgggtgctccctttgattcttgaactagttttacttctcaagcttgaaatatgttcttgtccttaatatctggctatctcctgtaattaaataatattcagcagctggtatacacaaatatatcgagtgaggtcctatttgcataaactcattcctcataacattccatgaagtaggtattatccccatttacagatgagcaaactgaagcacagagaggtaaagaaacgtgactaaagacaaacacagccaaagaatcaggacttgacaccaggtaatttggttctggaatcagtgttctttacttctaacattgcttctcaatgtgagaaaccgtaggcatatttaggaactgcaaatagctcagagcggccagagtgagtactgggacaaactggaggtaagtttagaaaagtagcagaagggtttcaaatgacatgcaaaacaactaagttttcatctgacaggtgatggggtacaccacaggatcttaaatacatgatcatatttgtgctttggataaacagctctgtggaataggtggaatagaaggtgggtaggaggagaatggttcctgactcagctttttctaaagactggacctgcgcctccttcctggatggggcctttggatatccattgtgaagaacctgcatgcaattataatacatgacttcccacaacctaggcctgggccttccaatgatgggatctccctttttaactacaacttttcctttgagtccctttcatcagctctcatctccaagtctttttataagcatacctctatttccacactgatcccgatagtctccttatttaaatccttatcaccacaaatgtagatttctgtagcttcacagctcagttaccttcttcctaacgccaccacctgcaatttcatgagctgcttttattttaatccttttaaaacattactcccttcatcatattattctcatgatcaaataccttactattgcttatacagatagtcttaactgttaacctaacattcaatgatctttataaatgatgcccaaatcacattttccaatcttctactatctcatctacgctgctgcagtcaaattttctacccatctataaactgtgtgtacacagtgtgtctttctataatctttggtcacactgttactctggtctagcaaaacgcattcttttaaaaatcccatcctttcatgatctggtttagcacttgccgactctaaacagccttcctaaaccactccagtgctgggaattcctacagcactcaaagccttacaccatattcctatatttgggcacaaactgcctcagtaacatgacatcccttccgttattgctctgaattttttattcatttcatatattaggatttagctgtttacaggtcacttttctaatgacatcaagaactactcaaagacacattgtgtgtgtatatatatatacacacacacacacacacacacacaatatatatacacacacatatatatatgtgtgtgtatacatatatctaaagacctataaaaccatgttttgtgggttttttttttttttggtatttctacttttcccatagtatttccatacctcaccagtgctaggtatggtactatcctatgtatattgtatacctcatgtttcttgataatttagaaaattcaatttatgctgctgttatatcttccagtaatataaaattttcagaattttaagagtttttcaggtagaaaaatttagcaaaaccaaaagagaaatggaggaaaaaaagtctaagaaaaacataaatgccagtggagtatgctaatgggaaaaaaatcaacataagcttcacaatttacaatgtctggagaaataaactgatgtgcttatacttaaacatgttatattacggaagactacaagtggttgttaaagagaacctattttgcatttatatttgaatttcgatagaactgctttgaattgctactttattgataagggaaaacaagttcttttatgacaagttataaaagcttatagtttatcagttccctctccaccctgcaattacctacaggaagagattggccatgggttctattttatgagttttataggggcccattcaccccagtttacatactatgaattcttggaaaatgcaatagattgtagaaaataaagtgcttcctttgaataaaggacatttcacttaaactcatacatgtatctacatacaagctgtcccaaatattatgttaaaatatgaaacagccatattttacatgaatatatgtataaagtatacaaaagtataatactgcaataggtagcaatcttgtcaatctacagaattggctaaacaatgataacaatctaacaacaataacaacccaacagctattgagtaagtacagatattatataatccaagagattcaggataaaatttaatttatatgattcagatcagtacatttatgaataagtttagtgttaatggcaaacaatattacaaacatctcagaaatatttcagaataacaaaataagactaacgcatattaaagtttactactgatgaaataccatgtgacaaaaattcattcagcccttagaaaactttgaagaaaggtaactgcagaaggaataaattaatagcttttaaaattggtcttataaatatgaagaataatgaatcaacatttaaatttccaatcaggttagaatgctttaaattctaataattaaaggaatacttaagacacatggcaagcgtttcatagttggtataatcctgatgagacagtctgaattttatttcaacctgttgtgatagatgtgtaggcctctgtgaaaatgcaagctgtaattttatatactgcccaaaatccatttgctaaaagaagctttgttctctctaccggggttacagggtcactgaataaaaactaaaaatattaatattagtgttacaagtttggaatgtaggagctttacaaaaatttaagttattcattcgaataggccatattgatgtcatttgaattttatcatattagttttcactggaagagattcaaaaacagtactcaagacactagaaattatatattcagtatggcttatcatgtttcaatgtattttacatgtatattaattctgccagaaaatatgaaaagctatgggatttgccaagcatatgactgtacactgaaaggtagatatgttttaactatgttccagggggaatacttccttatgctagttgccatttccctttgatttgcaaataagtccttcatttaaagtaaatacaggactcaaacttgtgctgacttaacaattaactaacttttacacctgccttttagggttcagacaataacctctgattaatctgggctgatattatccttaacttactataggcgataagcaagtgcagagggactaattcttaaagtggcatgatgtaagtcttttcatataatctaacatcatgattatctcatgtcttatttactttttctattatcaatagtacagtgtctgaatgaatatcattcaggacaaaaattagtgaaaagaaagccacacatttaaccatcaaatctgacctaggacattaggtataaagaaaataaaacaatatctataatatacgagcaggccacataggttccttacacaagagaatgactagcagtctgatgtccaatgtctcttctgcaatactaaacgccagaatgcaaagataatcaacttccacaatgttttgaggagaaaaggttaagttcaagtaattaaaaatcttggcaagctgtctaatagtaaaggcaattgacaagtatttaaaaatatgcagactcagataattcacttcccattttctaattcttgaagaacaactagaaaatgtactctgaggtataaacaaaatgaagagctcagcatgccaaaaaaattaagtgattatagacagttaaaaatagaggtttgattctttttgacgaaaggggtgtcacatcatgtggagatttttttcactttctattaaaggtatctcaaaaaaacaaatatggtactatttgtaagaaagaaaaaaaaaacccaaacaaaaaaatcaaagttcatgtagtaaatgaaaaacaaaaaggaaacaagtgaattaaaaagagagtgagaggtgacatggaacaaagggacagaggtggttttgttctcaggctgatctttatttactgaagggacactggattgtattatagtactatagaatcaaactcaagtttgattgaccataaccatatatttactgaaaacttcacttagaattccaacttggaatgttaagaaacatatcggctgggcgcggtggctcatgcctgtaatcccagcactttgggaggctgaggtgggcagatcacgaggtcaggagtttgaggccagcctgacctacacggtgaaaccccatctctactaaaaatacaaaaattagctgggcgtggttgtggacgcctgtaatcccagctacttaggaggctgaggcaggagaactgcttgaacccgggagacggacattgcagtgaactgagattgcgccacggcactccagcctgggcaacagagcgagactctgtctcaaaaaaacaaacaaacaaacaaacaaacatatctttcccttgaaaagaggtctgataaattctcatttgctcacttccctcacccatttaatggctgcaactagcatataccactctcctagaactgccattcatggcagtacttggagcaaggggaacgtgggcatgaaaatgggtaaagaagtaagctgggaattgagggttaggtctggggtcgagaagtcactcagggtcccagcctcagctattctaaaatcctggcccactccctttctgtttttttctcaggctctaacagatacttaaatcatggtatctcttctttttttgggtcagtagaatacaaaatttggggctacaaatattccactttgataatttttagactcctttttttcctccctaaacattttcttctcctaagccctttaaagaaaataagagaagataggttcaaggatggaaattagataaaattacatttctgtgaaaatcagactttacttgtcctggtctgggaccagagggcactgggcaataataatgaacagacttatgattctatttagaggttatggagaaagggcaaagattaagtgttggaaagccaggggctgttggggagagaggtagtaacatccttactttgtagtagagacacagaaggagaagagtagccaatccttcctcagaaaaatacatcaaaaaggactgaatatattattcaaatacattaaaataataaatttttcttaattgccattctttaattttttaatactaaagaataaaatttatatcatgttatggctactcttttagcatacttactaaaggataactgaaacatacatactacagtcaagttctttttaatgattatgctaattcctcatgtactggtcttttctaaagtcccacatattaagttatcaaacatgttaaatcaatcatagggatttattacaaataaaaaatagagtcaatttgctactgaggcatatattaatcatcaacacaattcaaatactttaatattacctttatttatttatttttgagatggagtcttgctctgatgccaggctgaagtgcagtggtgcaatctcggctcacagcaaccttcacctcctgggttcaagcgattcccctgcctcagcctcccgagtagctgggactacaggcatgcaccaccatgcccagataactttttgtattttagtagagatggggtttcaccatgttggccaggatggtctcaatctcctgaccttgtgatctgcccgccttggcctcccaaagtgctgggattacaggcgtgagccactgtgtccggccatctttattttcttaattggtacagtttgactatccctaatccaaaaacctgaaatatgaaatcctccaaaatctgaaactttatgaacattgacatgactttcaaagaaaatgttcattgggacattttggatttctaatttttggctcagggatgcaggaagtgtaacacaaatgttccaaaatttgaaaaagaccaaaatccaaaacacttctggtcctaagcattttggataagggatactcaacctatattaccaaatctttctcacaataggaaatggagaatcacaggaagtacttggaagacttatgaatgcaaaggataagaaataagagtaggattagggaatgtacagtgtactctatatcatcttatgagtctttcaattgcaaactagcaactaatatatgtttcacacaaatatcatattcagagactaaaagggaaatctaataattatcttccttctattaatacaactttttaaatatagtgaatagatgctataattgttaaatgccttttgttgagaagaaggataaaagataagacttcagttctataataataaagcaaagtaacctataagagaaatgaagcataatggccttttttcactattataaaacattcactttaaataatgatgctagtgcacaaaataacattcatttttagaagggtaaaaatcaatttgcacaaatacttacattacattatcaaaactataaattatttctaagttaacaacattaatatgaacaaatcttgcagggatataacttttggcaaaaaggttttaagagttttctacaatggcactgtaactataaccagtataattttgtactttcttaacacttttaacaacgtagcaacagactgtcttaccgttggtgctgtatctacctgatggttacaaggctttctttctatgctgataatccctgtggaaagaaaacattgtgagtatttggttattaagcctgtccattttatgttgaaaatattcatgccattttattggaaaaacatttattatgactcacacagcttccaagaaaaaagtctcacttggaaggcaagatccttttaagatgtatcatgaattctttggtcagaaacagttggtctaaactgactcaaggttagctaagccttttttcccattcaagtgatgtctagcaatagcgcaagatgtgtccacatcctgctctcaactcaaaaattacaccattatctgggctctgctgcttttcttccatgaaagttttatttctgattcaaggatatgaagtttttaaaaagaagtatcacaagggctatgaagtgaatcactactgtcttattttctcaaaagaataaataaatccatctgaatttctctttgatcatctgacttcctactatgacatactctatttattcaatcaccatgagtatctgaagaaaaatgttcccctgattccctcctttaaaatgataacacagatggctaatcttgagaaatattcttttatcatgtgtggatttatctttttgttcccaatgttctctactgcatttctttgtaataaacaccctttcaggacgtgacacaggggatctcatctgtaaagatactggttcaaagtctaactcaagttaaaaatgaacacaagtgtgggtcttgtttaattcctaatttctggccaccagcaaactaacatataatttaggatattaacatagtttgttcaaacaatgctaaaggctgtcatatgcaggacaagaggcaagaactacaatgtctgttaatagcaattagtaaaattcctagtttaaatgttagtttctcttctacaagcatatgactcatttttcttaaagtacggtaaaggattaagtgagatcaacacaaacaatcactttttatcgctttgcaagagtattttcaaaatgaatcatgaaacatgcagtttttgtttcattaattttttgtaacatttattgttagccagtgaagtataaagcactatactaccttcattcaattgactaatatttttgagtggttattcttggtactcagtgataaaagatgaatatattacagtttctgactataagagtctagtaaaacatggatatccttttctgaagaattaccacagagcaaatgaacagagtttcatcttaagtgtaataaaatctttaaggtaattttgatggaaagacactcttattcatagagtaacaccagttttgggttaattttttttcaaagggtacaacatgcaggcaaataagtaatgtagattcctattgtaagattttaacaatatagaaatatagagagaataaattgagaaatcccaactttgtcagcccctacagtctcacaatcctagctgcaaacactgagaatagtgtggcatggcaactggctttcaaatgagagtggtcatgccagagttcagcaattaacaacatcttacacacgtcttctcactattgtaatctgactgttataaaattgacctaggctgattactgatttttaaattcttatctaaacagaaagtaattttaattggagaaaaggaactttaaaataataaaaaccaaagcaaaccaggcaaaaatctatatatacagtttatacaataccaagaaaaaaacaaaaaaaactctacagattttagtgtttccattttaggataagaatgtgttgaaaattagaatttcaaaaactggattatccaaagttataatcttagttttaaatttagattacatatataaataatatttggaaatacaatcatgcatgtttgttcaagcttgcagtaaaaaatatatagaaaggaataaactttagaaaaaaatgtatcaaaataacttcctattttaggtaaattttacttaaaaatctgtatttgtatctcatttcacttttattaatgtataacaataattgaaagctcataataagtagcatgctataatggttagtattatatgtctacttagctaggccatggtacccagatacttgatcaaacattattctagatatttctttgaaggttttagatggaattaacatttaaatcaacaggctttgagtaaagcacactgccctccatgatgttaagtgggcctcatccaatcagatgaaggccttaagaaaatgacaactcacctgagagcgaggggattctgccaacaggctgccttcagactggaactgcaactctttcctacgtctccctcctgttggcctagcctgcagattttggtcttgccagcccccacaatgtttgagacaattccttaaagtaaatctttctctctctatggtcttcctactggttctgtttctctggagaaccctgactagtaatatacttactttctgggacatatgaaataaataaaaatgctattgcttatactctaaattataaatgttatgttcattcaacataattgtgtaggaatatagttaaaatgttgatgttagtatgaaatattttaaaatctgcatatatccgaatgaactcaggaatatatagatagaataaatcgacctatcaacaaataaaaatgaaaaaaattataaaagcagtctgtcagcagaataaagaatcaatctatcaataaatattactgctaggttgtccagtctaacaatctctgcctttcaatgatttgactatttacatttaatgcaattactcatatggctttgctgaagtttagcattttgctatcttattgcatttctttttgttcttttcttcctctttttctatattcttttgcaatagtcaaatagttttactcttccattttatgtcctctgatggctttttagttacatctcttcatattttttaatggctaatgtagagattacaacgtaccactgtactataccttgaattaggatttcttctacttcaagaataatataagcaacttaaaacagtgttaaccccatttattcaaccaccctttatgcttttgctgccttatatttaacttctatatgttataaacaccacaatatattgtcagtattgttgttttaaactgatatatttatctttatcccttcttgcagatccaggctttcacatgagatcattaatcccctgttattttgtagtgtaagtctgctggtgactatgttttttcctgaaaaatctttagtagggattcatttacaaagaatgttttgctgggtattgaaatctaggttaatagccattttcttttagaaaatgatttcattccattatttcttatgagaaggaagtcatcattcttactatgatttccctgaacgtaacacttttcccctctggctgcttttgtaattttctttttagtttaatcaggaggtacctaggtatggtttcacacacacacacacacacacacacacacacacacacacacacacacacgtgtgtatatttatactctaaaggaatataaatttttcattttcttcagtttaattaggaggtatctatggtttcatttatatatatgtatacgtgtatgtgtgtatctttggattttgctaagcttttaaattttattttttttgattttattttttatttcaataggtctttgaggaacaagtggtgtttggttacatgggtaagttctttagtggtgatttatgagattttgtgtatctgtcacccaagcagtgtacactgtacccaatgtgtactcttctatccctcacccctgtcccaccctttccaagtccccaaagtccttagaataagagtctccaattctatccaggttgctgtgaatgccattattccattcctttttatgactaagtagtattccatggtgtgtgtgtgtaggtgtgagtgtgtgtatatatatatatgtataaagaaaatgtggtgtatatacacatatatatacttggtgattgatgggcatttgggatggttccgtatttttgcaattgcaaattgtgctgctatatataaacatgtgtgtgcaagtatcttttttgtacagtgacttttttttccctctgggtagatggtagcgggattgctggagcaaaagcgctacttttcttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcc

SEQ ID NO: 995 - DNA, 213795 bp, Homo sapiens; identical to SEQ ID NO: 994

SEQ ID NO: 996 - DNA, 193039 bp, Homo sapiens
catggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgtttta

SEQ ID NO: 997 - DNA, 109983 bp, Homo sapiens
ataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcc

SEQ ID NO: 998 - DNA, 213795 bp, Homo sapiens; identical to SEQ ID NO: 994

SEQ ID NO: 999 - DNA, 275750 bp, Homo sapiens
tttgctcatattttttttttaatgtatcacaatgagcaggaaacatacttgatgaaatattttcaaaggagtatattcaattaccatctacaatcaacttaactatgacaacaaagtttttgtgacaaatttttttttcagtttgaaagttccatgtggttctgtttgttagtctccatgtattttggtacagttcgagatcagcattgttacagtaacaaaaaagctaacaagactacattatagaaaaacaccaagaacatcatttttggtttcacttgctctattttttttgttgttttttgtttttttttctttttgtacattgcaaaggctgttcatatacctcttcacctcagggtcacgttcatttatgctttctttcctacccaaacttgcccccctcccccctgaagaaagtaaacaaacaaaaaactagtcaaagctttgtttcacagtgggcagtatctcagcgccaacaaacaactcaatttatgcttctatttaaaatgttttaatttattatttaaaaaaaatatatgtccatgaacatcaagtgcactggcttgggtcactgcctctctctcctgcaacttcctgccatgcctgataaactcaggtttaaacacatgccgtctgttttactttattttcaattgtgtaaaactttggccacattcatctctttaaatagcttgtaattaaaaaaaaaattcctagatgtattaaatttttccttgtgtagatatgtggtttttggaaggatggaggaaagatggatgaaataactcccattctgtgggtcagactggtgtctagcaccaacccacactatagggagaaaaccaaaaaacgagtgtcaatggaggtgaagaactaatttaaaaagcaagtggaaatatatcctacccagctacctacaatgcagcagacaggaataaattccccaagtgagataaagctaaacaaacagttgagcattgtagtgaattcatgctttgtaaatagtactggtcatagccacgatggctgtcagcccacaaacatctaactcatgtttgacctctaatgttcaccatcactgactgctttgctacttctgggttagtgctgagaattattcttacttttttcaatgaacatatatgtgggcggtttagttgcagaggaaagcattaagggtgcaacccactccaggttgaaacaatcacataacccctctgagaacactaggtgggtggaagtgtgctcagccaatctattcaaccaccttattgtcgccaaacacccacagctcaaggcatggcataacaaaacactgacagtcactctgcctcacagagggaggatggcatagtagctccatgaaaaaaaaaaacaaaaacaaaaacaaaaacccaaaccatcagggagggggcagcaaaattataaagaaaagaacttaaaagttgaggggggagggaaaaggatagaaattgcactattaccaagcaatatcatttttaaaaacaacgttttcagagaagacctagcagaatttgacaggtaaagctagtgttacattgttaactgatatcacatagagaaccaaaaacaaaaacaattttttttctatatggtacagacacagagtaacatacaacagttaaatggcaaaaaatatatatatatatatttcatagagttacaaacaagataaaataatggaaaacaaaaaactgtacaactttaaaatttaaaaatgttcatctcaaacacaggaagaaatacaagatttcttgttaaaaggaaatagcttgttaaaacagtaaatgttttgcgtacttgcttttgacaccttatgctacaactggatactggtatgaatagttagatggtattctttctttagtatttctacttaaaaaaaacaattaaaaaaggaatttgcactgtgcatcagcctagttagaaatatgtacaacatttcaggatctactatttcattaaactaaaaacaaattcataaaaataaaatagtcccggctaaaaaagaaaaaaagaaaaaaaatccattttcagatcttggaatgctccagtcttttgcaaagtcgatgagtggcttcagcactggggaaagaagcccgaaaggtgaccaatggaacctgtattcacagtcttcaaagttcccttttgaaacataaggaagaaaacgaagggaagaaggatttcacactttgggggcaaggggagatggtttctgttgatgtttagctatgaaagtgaaacagcaaagcatctatttatttgtctccaaaatctatgttttagcagcacaaagttttcaaagttcagaccatttatttatttttctttttacatgagaaagggtgtgtgttaacaggaatatggatattaacagaaacaagtgcctcacatacagttccttttttgctttctgtacactgctatctgctgctttgttggctgcgctctggatcactcgctgctcagactgcctaacacaaggacaaaactttgaagtaaaaaatgtgtcttttggtatatggaattgtcattaacatttgcctctctgcttgcagaagaagcacataacaacctgggaatcttttgtttttctctttcttttattaaactaagtcttgtttgtttaaatcagaaacaaattctcaagtaacaagaaccctttcccttttttctgcatcagcagtgaaagggtgtgtctttggattttatttaaagcatgaaatttttttttctgagagaggaaagaaaaaacaaacacaaaaccaaaaaccaaatccctaaccaaaaactttttttagaaaagaaaagtacacagccaattacacaaatggaaacaaatcctttagtatagaaaaaaaaagaatatttgaagctcctaccaaacaaggaggaaaagaaggggtacaaagaaaaaaaagccaaaagaaggataaataaaaaataaatgcacaaagctaacagacacaggtaactagaattatatgcctttaaaaagtttcaactccccaaccaaaaataatctgtgaggatcctaatgacccctagaatcccttgaaattctttctttagttttataaaataattctgcagctccctctaagaaatgaaggcagctaccttaagtgggagattataggacgggaggtgggagaaggaaagagaaagtggaattaagggacaagaaagagaaagtggaattaagggacaaggggagaaaagcttaggcgaatcaacggattgcaatctatcatctgctaggaatgaacaagacaacatcaaatgaggagctgtcagctggaccatacaaaaagctaaatgtacacaaaaggtttttttttttttttccttttaaatctaccatactgcttcagttcatttccaatgcaacaatctactcaacaccaaaaatggtcatatctatcataaatacagaaagtcagtttttaaaacttattttttttaagctacaagtcctcaacactctttgtgtgtgtgggttattatttttttttttttttgaaagtgggagtgcttaacttttccccttgaaattggcttcagcagaaaagctatccttaaaaatccccagaaagctaaagcagttcacattgtttttcttgaatactttctgcccatttttaagttaacaaaacaaaaaatcttttctggaacaaaaaaaaaaaaaaaaactgaaaaaacaataatatataaaacaatgattctgaaaacaaagtgtgagcgattgacctgagaataaaaagacattacatttctttttttcttttagcaagccattggtatctgaatgctaagatagcaagaaatttaaaactgtaacaaggtggactgctttcccatacagtgcatgccgggctcctctgtgctatcagcgtggggcgtttattgaaaaggggcaaatatacaaggggtttaagctccaaagacattagggaggccctgcggacttctgtttcccagaccaatagtaccttcaaaaggacacaatgtaacagggttagggctttttttttttttttaatattaaaagaaaagaaaaagacaagaatgtaaaatcaccggcatagataggtatatgggaaaacaacccacgctttttcttttttttctttttttttttttttttgttttttggttagaagctttggaattgcagttagtctatttttgaaattggtttgttattaatttttgtatttaaattcatttgtttgtattgttcatcttcaaagcttacaatctgaaggtgtccgttcctacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgaggtaaccgttgaagatgaggagagaggaggaaaagaagggggcttcgctgccgaagcccgggagaccacttgcggccaagacttcctggaggcgtggggggaagcggaggagggggcggcggccgacgggggaggggggctgtcgtttgagtgagcggcagactgcgaggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccgccgccgccgccgccaccgccgccgccgccgccactgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggtttgggggattctttggcagggtctttgtctggggaaggagccccgggggggactggggtttggcttgctttgggctgctgctgctgcactttttgctgctgctgctgctgtagttgccgctgctgctgctgctgaattgcctcctgcagactctgctggtattgctggtactgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagcggggctgagatcgtggctgcagttgccgtgggggcctctcctttctccttcttggggacaggcaggggttcccctttccctttgtgtgccttttccttctcctttactttctcactgtctttgtccttgcgttgctgctgctgttgcagtgggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagagaagatgatgaataggaaagtgtggaggaagggcctgggaagaaataagaacaatccattcagggaaaattgcttccatgccttggcccagctgacctgcttcaacaagtctactcaacagtataaccgcctaggaataggaatctggaatctgcgggagaaacgaccatcttcttttcctgcccctgtttgaatgatacacaggagggccagtgggactgtagatggttgagaaacaaccgcaggaaaagcagaaaagccatgtcagaagtggaatagcccaagatactgacaccaattcccaagacatcacaacctacccgaagcaccactgcctatggatagcaaaggtctgaccatatcaccaggccctcatgggctagaatcccatccttgatcatacccctaatctaccaccactccctgcaacgccttcaccaacccgagagcctaataccctccctgacccatagctatctcctggtttgagtcaccaggtccaaggtaatgcaagagggtgttgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaacaagactgcttcaaattgccaatcccagacaaacagctgttaatactggatagccaaggagaaaggttccttcagcatctcatcatgcagtgtcctcagtgcacataagacaccagagaagatatgtgtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctacttttttttcacattactatgatgtgttaagccttcccaagcccctctgccagggtcctgggctgcaggggtaattaaatgcttctctattttccatagtttgttttcctggcttatgtctagctggctttctgtgacatgacttgtcaacacatataagcaacaacttctatgtcttaatgctttcttttcttattctctttgaataagaaatggggaccaggaatgcagtggccttatgtttggtaaaacaccactcaaagtgtaaaatgtggaactaattcaaccagaaactaagattgctgtgggaagcagcacagctgctttaacccctgggaacagggacacattttgaaggcaaggtagcattaggaggggttctcctttggtgaactggaactaatcaattcaggccattgtggggggaatttgcagacttatgtctaagcctaacaggaccctggaggtgaaggtccaatttagcaaagatggctggatccagagaagatgtgaggacagagaaggagaaacaagagaagtatgtaggaagaactgcaaaactccctattaagtgagactataagagcaacaaatatgtatgattctcagtgatcaggagcaaggaaaaggaaatgggcaaaaggaaaaaaaagaggtgactgaggacctctgaaatgtgcatcagtattttaacagaaccacattgcccaatacaagattcctggtcagtgcactcaagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggccaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaacttgtttcttgaaatattccagaaattagtatgccaggaccctcaagtttttccctattataggggataagagtggtttcaaaggagactgttccgaccaggaggtcccatccctgacacaccagtacttgggagactcaacaggaacgaactgaagtcttgttgcttttaaagaactagaaaggtaagcttcccatctgcccagcactcagagggtttgggtggtatccacataacagaatgctgactgggcagctatttagccctgaaacaatcgcctagagcagaacccacctgtgttggatggagtaaagcctggcaaggaggggctgttgaggcccgggagcaacacaggaggaatgccctggagcgctggatatgctgtaggaaggttaagggcctgaagaggggtgttgtcaaacatcccttgctgctgagctgccagtccaaggacctcgttggcctttttaatccggtccaactcttgttgagccatcaactgacgtacggtggctgggtcaaagtattctttctccttgtccagctggcttccaatggtgtctttaactttggagatatgctgttgggaaaagatatggtcacgtacagacagccgagcgctgtacttgatgccacacaaagtgcactctgttttgggtccctcataactcgtttggtttataccaaaatgcttggccatgcttaacttggacttcttttcttttgcccgggcattctggaaccagacctgaacgactctctttggcagtccaatgtcattgcccaggacctcacattctagcatagtgggtgtcctgtagtcattaaagcatgacttgaggaccttcagctgcagattggtcatttgagtgcgaaaacgtttctgcccaggccgatctccgctgtcaccagatttgcctgcagatccactcgcaccaggactcggggagcagggatctgcaaggcttgaggtttcactgtagtccactgtaccttcattgtcatattccttgctataaaagctcggggccgggctgaccagaccagatgacaaccgatcttcatactcagacattgccatcatggccgctttggtcaacccttcgttgggtgcagaagaggatttggtttcagttgctattcccgttgcactgtcgttatctgcgttgccctcgtctccagttgtggtatctgtgattgctgtgttgacagaggaacagtcatcgttgtccagcttagtttggtcaaagtttagattaactgaggacatggaggggctttcaaagtcttcaatcccttccaccttaatggaggaagggcttagaagagttctgggtgacaattccatggttttactcacaggtgagagggggacaccctgaccatcactactgcttgggggtaggtgggaaaagctagttccgtcaaaaatatctcctttcatctggagtcccccatcacagtctaagagcatcgcagacagagttaggttgtagccagctctcttggcttcatgccagtgacgggaccggatatgagcctcaagagcagtcttggctttgaagagcgctctgcaaaaagggcatctcctgtgggcctgcgctgggcctacagcccggaactgtcctttcctttcccgagctcgggtgttctgaaaccagacttgtaccacacgtttcttcaagcccacctcgtgtgcaatgtgatccaacatctttcgagtcggattggaatccagtagatacttctggtagagaatttctagttgttccggtgtgatggttgttctcaaacgcttgtctctctgaggctcttctcctcctgtcccactgtcgttttcgccagggcttgcactggccttttcctccagcttcctcttgagagtgttcattgtggaggttggagttgaaggagaagtggctgagcttgctggaatctgaggtatggccccagagagcagctggctggccaggagtgggttactgggatcaaagagcatgaaaggcatatccagggacctgtccaaaaactgggggtggatgaactggttctgcgcgctcaggaagtggagctgctgatgctcctgccagtgctcaaatgacggaaatgccaacttacactggtcacactggtaggggattagctgaggaggtaggtttgcgagctgttgaggagttgatgtgtggaggggcttgaggggcaggtgggagagctgggaaggactggggctcgactggggtaaggggcactgtggagggggcgcttgtggaggaggctgtggcaacgaaggcagggacaccagctgggggagcttctgctggggagtgttggtcttctgctcgggctgctcttgctgctgcagctctggctttggttgtccttgcttttcttgggtttggtttggctgtgcactgggagcttccgccagctttggtttctcatcgcctgcctctgtttttgaattgaaggtggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcatttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctcctccaggctggtgataggaggattactgaagttgtaaggggagtccttgttacgctgcctctctttgaagagagtgttcctgaaccagtgcttgatcactttctggggcaacccggacttgtctgccatctcttttatttgctcttcactgggggagttgttaatgtcaaaatattgccgcaagactcggagctgatcatctgtgatcctggtgcgaggcctcttgttctgctgctggagcagggttggattgagctgatgctggtagagttgggccaggtccgcaggcagaggctccacaggtcccagctgcgggggtagctgagccggcaaggtctgcagcggcatcgtctgcatcatcagcggcgagaagatgggcagctccatcggcatggagagctgggtgagcggcactgatggctgggccggtgcaattgtaggtgaggtgatgggtggggctgatgcggggatggctggtgtggacgccggctgaggcggcgctgccggaagtgggggtggagggggtggagggggaggtggtggtggctctggggtctggggcctcagtgggtacagtttatcgtagtggtctctgtactgtttggcaaacctctcgagctgtttgaaaggaaagtaattctgatgaacgtgctcttgatgactctttaaaatcaagatgttggaaaacaacttgccgcaggagtcacactcgagcttttccaggttctctccctggtcagtcttcccattctttttctgcaccttctgcttgttctcattatactggatgaccaactcaaagccaaagttctccagcagggccttggtggcgttccctctggcatctgaagcaatgcgtggagggagcatggaaggctcagaaccaccccctggtgccaactctttcttctctttggccttcaaggcatctggcagtgtttccttcggaccggtgttgccctctcccccctcggcgctgtccctctctctctggctttctttttccttttctttgatgaccaatttgttcttcttttcggggtgctggcttggctgaaggagggcagagtgactctgggctatagagagttggttctgctgctgctgcggcaagatctgctgatggctctgctgtgggacctgaacctgagccttcagatcttccagcaggcctgggcctgtcccagtcagtgtcagtgccccactggtcactggcaagctcacctcggggttaagctggaactcagcactggggatgtagaaagggaagaggaggtgctgctgctgctgtagttgcagcagggtctcagttgtcatggggaagtgaggaaggagggtggggttaaacagctgagactggatcagggcagcctgttgctgcagctcctgctgcaggtgagcttgaacttgagcctgggcctgggccagcgtttgtgcttgttgttgttgttgttgttgttgttgttgctgttgctgctgctgttgttgctgctgcctggatgcaatcatatctgccagtttcttccgattggcctctttgggctctgaaggggaagcaatgttggcaccaataggattccccaggggtggcatccctacactctcagtgggcacttggcttagtaagttagagcttggagcaatgccagcactgcttggattggaggtggtaaaggtgttactgccactggtgctcacaggacttggcgtggaggagctcaaggaaatactgctgctgttcccagtcccattgctgctgccacttgcagcctccagcttggctgcccgggccttggtttgatgtaacacagacctcatatggatctccagagtggaactctggctgtaggccacattacaagtgttacacttaaaaggtttgttgtctgggctgctggtgggttctggctgaccggttgctgattcttgaagggctctctttaacttatgcaggtgggagacagaattgtagtgtactagcaggatattcttttgagtgaaagattccttgcagacggtacacttgtaagggcgagaagggtctaggaacttttccatagtaaaattgggaccttttctgaaaggcagagctctctttggctctgagcccgagtcttcttgtactgacccagagtcactgcccgttgggctctgtttatcttccaagtcactctcttcctccttgtcttcctcaacaattatggtatggtcctctgccagagtggggtctcccattgccaggaggtccccattggccagcaggccaccataaagctgttggatgtcagcctcactcagctccaggtggcttgtctcaaggtgcttcttcagagcctggaaagttcggaaactgcgctgacaaagacagcacatggtggcagctctgatcacatggtactgagaatggagctgcaacttttcaatggtcttgaaggccaggctacactgattacagcggtacttgtacacatggcgatctgacaccggcagctgaggcctcttggcatgcacttcattaaaatgcgtctgaagggcagcagaagttttgaaaacctggttgcaccccttcttccagcagatgaagcctgagtcttctctcacagagcctgggtcagcaggggatggtttcaaatctccgctttgctctgtgcttgcggatggcaagatgttctttcccagatcctctgaggtttctgttaaaaaaaaaaaaaaaatcaaacccaaagataaagaaggctttgtttcaaggatggcacccagagcggtctacctagtcaggcctcatgaacacagaatctgatgatgagggaagtgcccaacctgaatgacagaatctctgcggagcgcctcctgctttcttttgttcctccaatagagcacatattataaacagggtgcacatgaacagagatggataaaaggaaatacaaaaagtttcaatgcataatagacccatgtcatatcacagatctaacagtcttttaaatagcatttaattgcttgactcagaatcctcaatttctcaagagctggtttgaaggttactgatcttagactggatttcccttttatgttcatcttttatgtaataagcatttagcacagtagatctgaagtgtagaatatgtgaattaatgctgtcctaagttgtgaggaatttacaagaactgctgaacatcgtaatataagaaatttggggatacatatttttaggcatttaatttcttgttataatgtgacttctgattgccatctctattcaataagcaattaacattcaagtgttcaattatttaaaatacatttttttccctacaatgagatcatcacactcataaataccgagaccctttaacaggtcatttgtccattgtctaatatggaaaactcacaagaaagagagaaggcaggacagtagtgtggccaaactcttcccaacttagaactcttcccaccttagaggtgaacgatgtaggacagcctcacagaggtctaaccattcatctagccaggaaacactatgtggcaccaactactgtctacaacaatgttctttccatcagcatctctgtgcttcatcctaagccaatcccaaaaaactcagaacgaaagacaactaatccagtgtacctaaaaatcaacccacaagtccctactaattaagtcctcagaaatacagtgtttaatggcttagaatggtagggcctactgactgagtctctggttattcactccctaattgtatagtttaagaagatgtgtgtgtctgtgccagaattccactggttctcatactaattttctctcactttaaaccatgtgagtaatatacaaatacatgccaagaagcagagtataaagtagctgatgacagtgcccctcatctcctgatcagttacattcaccttaagagtattgtaaagaattcctgaaaacctttctccatgaacattttggcattccatcttgtttcaatttcttggggtcaagaataatgatactgaccaggctgctttcctgcctcttccaaattggaattcccatctcgatctggaacagctgctgggaggaacatgctgcttggcatcaccatctcaggggtggtcacctgaggagcaagagcaaggagagtcaaatggagaggaaagcgacacaaaataggaaatgtttaaaaattatttaataagcaaaattagccttcaccagtgtaaagctagaggtgtctcacttttcatagctcactgaagattcatgtttattagacaaagctcacatcagtcaaaagtgtttctacggttacattctggacataattagcagtgcacacttgaagaataatcttcttattaatatttttcctttatgcagaattttgactttgatcactgacaatgttttgtcatgggctgtgaaacttcttgtgcaaccaattaggtagataagttgaaaggcccaccttaagctgctgaaaacataataagggccctaattaaatcatacctagtaaagtacactgtaatcttgaagcagggagcattgtagtactgttttcagaacgtattcaggcaagaggaggaggggagtaagagtgaaggaaagggtaagaagaaaagaagagaacaaagggaaggctagggacacgcagacatgctggcagattttccaggaaaacaacatttgtaaccctttacaagctgacatcaagcacaaacaagcctttttttgtgactcacttaagccacgatttcttctggagtctctgcccaaggtatacaacatcagagggaacttctgaccaacgtcccagcgatagagggtggcctgcacagcattctacaacagggcagccccaccttgaccatggccattttttctcaatacagcagttctggaaatcgcctggatccaaacagctgcaacttttgggcagagcctcagatatttctctaggcctccctgccgtacggccagaagcctgtccaaacaagttatcatttgccttatgttaatgtgataagcagccctcgatatccaatggaaagatcaaaggttcttcattcaaaaagaagcaatatccttttgcctgatatggggtgggaagggtaggtggcgatgatatttcaaatgaattagaaaccacctcccatttgatgatagctggagaaatggactgacctagaagttacaggaccagaaactacagtcaccactaacctttctacgtggcacccagccccacttggagacattatttttccatcaaacacaaccgtactgcacagacatcttcactgtctgttgcaaagattggaatacgtagatttctgttcaaaattaaataatattttaaatacattactattaatttttaatggtgtgacgatcccagccttgctcaaaatagctactgagatgtccactagaatcatcagcaataagcttgacaactagaggaaacccagacagccacccccatcaacataggataactcctcatcacacttaggggtattagaataatttcagcaacccagatgccagcgggtgcaaaaagtaagcaacaggtaccatggagaagcattctgagaaatgctgtgtttacgaagagcaggtgtgtggcaggtgaatgtgtgtgacatagcattcttgcccccacagacatctgcacctcacacaaagctcatcggcagctggttaaggctagctgttgatgaatcgttaagaatggagtggagattgccaaactcattccatctattttctttttaatagaaggcatttctgactagtgtggttggggagtccagcgggaatccgagaagtgaaaggtcaccgattaatttgtagtcctcagctgagggggagcacgaggttgggggtaagagggggagaaagggaaaggaaaaaagactcccccccacctcctttctcggttgtagctgcaagatcagtcctttcctgggatctttaggaattatgaaaaatgaatcatgagaaataaaaaaaaagccctacagagtaaaaaagaataaaattatctaacacctcagctgcacatcattatagaaaactgtgggcttttcatacacattacagtaaggcagacatcccctctaacagactcagtacgacggatcagtaattgttttcatacactttaattagaaaaactcagatggctatgaataataatggaaaagagagacttttgcacttgaaaggttgaagtcaatcaagtgtgaatgacggcaaaaaagaaaaaaaaaagacaccaattcatcagccctctgttgtctcgctgcgactttaatcataattcctgattgggattcaagaaggcagtaagcagcggttctttgtctgccttcaccttccatcaattaactctccccgaaatataatcatcaacctcacatgctcctctgcatcttaatctgggcctccaaacctgtaagtcttgccccatatgtgtttaagtaactacttttatccacctgcatttttctcatctatagtgtacccaacctctccctgaaaaaaagggggggttggtatatgaaattttgatgggcaagaaattcccaggaggcaaagaggaagattcctaaagagaatcctaaggatctggaaattcaggtggcgtctgtctgtgcatgtgtctcaacagaggttgagaatggaagctgccttgctacacaggctactggagggccccatgtcagttctcagacactaacgttccctttgcccattcttccctctcctaccagcttccaaagctttttactcaaagctttcatgctttatcttgaagagccataaacaatcctgccaacagagcccattgaggagtccttctgctcactgaggtgatatatatatccaaaggcagacttccttcaacacttgccttggcaccccctttgttttacaatcatatctggctactaaactgcatggaattcagactgtcccagccatagtctctaatggatagctgaaaatgggaaagtaataacccagctgtcggccgggtgcggtggctcaagcctgtaatcccagcactttgggaggctgaggcgggtggatcatttgaggtcaggagttcaagaccagcctggccaacatggtgaaaccccatctctactataaatacaaaaattagccaggcgtggtggctcatgcctgtagtcccagttactcgggaggctgagacaggagaattgcttgaacccgggaggcagaggttgcagtgagctgagattgcgccattgcactccagcctgggcgacagagtgagactctgtctccaatcaatcaatcaatcaatccatcccagctgtgctgagcacaggtaaagaccttcccttttgccaggaacactgaaacatgtaggtttatgagaagacaaaacctggttgtagcataaccagggtcatgccaagtgtgccaaatttcagaggccctcaaataactggtcctaccaccaattttcctgcagaacaatatacatgctttctctctgttccttcttcccctctctggccgcaatcctacaatgtccatacttccagccatggactcaagagccaaacgaaaaaagttctaaggtttggccaggtgacagtacaaatcagcccaaacacctacactttctacattgaatgtaccatccacattgattattccgataatccatacatcaataaacatttaatacattaaattatatcccccactctattcactaatgaacctgagaagtaatgagaagacaaaagtttttctggttaagaaaattcaactgattacagccattacagcattttgggtctctcaaggttggcctctgccatgcaaaaggcagttccatggtgatcttctagacaccacgttttcctcccaaaccttctgagccagttcaactaccttcctcccagagtacatgtacatttcatggaaacttgggaagaaaccatcagctgactggggtgcagaaaatttggaagccaacagtggctctgatatattcctaacaaacaggttttcatgcataacaaaagaaatgtagagttctactccagtgctcaaaacctcccagtttaagtaattttcatatataatagaaacagaagcgttccacattgatgctaaaaatgttcaagcttaagcacttccaaaataacacagttgaaaaggagtagccttgagaaactctcagttcattcaattgaccaccatttactaaataaacactgtacaggatccatgtgctgcatgcttctgagatgcagagagccagacaaaagttcctgtctccaaaaggcttatgatgcagaataaataaccctttagaggtcacaaaagccttagaaatctaatacaagttgcagactcctaggaaaatactttcacagaaagaatattccagataattttaggaaattacaagctccccagaaggaaatccatgtactcaagtgaactgcccttgatctactaggagaggtaacatataggttcataaatacatagttccaagctcttcctagtttggttcattattattttggattatgttctaatgcttttcaagattctatgaggtgagtggaccctaaagcctcaagggcacaccttatacagcccgtgtctgagatacgggactagtctcccactctgacatttgggaggggctgctgaaatatataatttcttggtagaatctggagttataaggaacaccatcctgccacttacgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagagggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgagccactacgcctggccagcagagatattttcttagcaaaagtggtgaacctagtttctctgagacccttattcctaccgccttggcattgctcactttaggacttctttctgaaaagcccactattccaggtgaaagtatagatttgccgatacctaggctcccaaggatgcctcaaatcctttacttttaattgaaaatcaatagaatgaagaaattcagacaaaaagaggagagacctcaggcacagacctccttggcacagaccaagccagtctctacatccttgtggatgagactggttctgcccaaaacattaagcatgaagttaaaagccagctgcttttagggctgagcagtctagctagttggtatatctaaagccagctgttccagcgagaggccagttgctcacttcctttcctgtacctagacagccactggggcccactggctggtttctgcacacttacagccaacaaaccagggcgcctcttgccagtagagtttcagagttgggttccccaccccactttacagtcttctacatatgccagggagaatactgggccatggcgtctttttaaaaggctcagcttcttctctccttgtcccatttccttttctttctttctttttttttttgagatagtctcactttgtcacctgggctggagtgcagtggcacaaccatggctcgctacaggctcaaactgctgggcttaagtgattcttctgcctcagcctcctgagtagctaggactacaggtacacaccaccactctcagcaattttttgtgtgttttgttttgttggtagagacacagtcttgccatgttgccctggctggtctcgaactcctggactcaagccatcttcccactttggcctccttgtttcctttctaaaactgcttctgtatggtagttcattcaatttttaaatacatcaagctcaaaagaaaatactgtagggccgtgttaacattcatgtaggctggaaacaaatgtagctcagaaccagatttttgaaactgaggatgagaaagattgaaaaggtagatgggagaacaggaaacacatgaagagttatacacgtgtgcgcagagaggtgagaactgagaaggagaatgaattggagagaaaaccttcattagactcagagagggaagcagtggcagtataccaaggtcacttctaatttagaccatctaattggcaaacaggctccaaatggctatcatctcacagggcttggaattaatgaaggctgattattttcattaccttcctcttaagatacaggcaaagtgagagagctggtacccaggtgggtgcaaccgcccccaggccagtggctgccctagagccccagataaccagcctgtcctagagattcacagacacacatgaagcatagagagtcacagacgctgacggaaaaaaatcacaaggttacaaactattggtctcaaaagagataccgagaaaagtgcaggcaacacagggccaggagcatggaagggaaactgtgcaggtacaaaaaatacagaataattaagaactaccaaagggagccaagacaaagggctacagaaggtgttcctaagctgcccaggagccaatcccatctccattatgaggtcatattttgttaaatgatgaaagaacaaagagaatttccccatatcagtgcttcaggatcccagtggtgtgtcctgtcacttagaaagatagtgatcaattagaataatttaagagtattgaaatgcatggtaggtggtctttcctattctcattcaggggacagaaacatgggccccatgccttccacccttctttcctgaaagaatgggaaaataagggcaccgagcagcagctcctacatctctttcaccaatttgaaatctcaagcttctttgtaaataggtgagagttcttatgtgtaactgacattgggggagggctgcccagccagttgtggaggggcccttgtctcatctcccttaagctttatagatttccttctttgatatgacgtgtgcagaggtactctttgcagctctgtttccaataggccaagaagaatgaagtgctgtgggtgtggtctccatagtggagggccagcactgcaattgttcctagtggagaatatttctcaagccccctcatcagtaagaagggggcccatggaagacatagatatgagatgcagagcataagcaagcagctgttaccatagcaacagacatattagacactgcaggttcctgaaagctgtctgataaggtattattaaatgaagcctcctcaaaacgcactccatttacaactgaacagaaagacgttgtgtagaaagtaatctgtttccatttatcagggtggaatttacttttagtgggactgaaccgaactcaagctaaatcctgagactttggacacagacagcaaaaaatatttaccagaatttacagctgtaaataccccggacacaccccatgtctgccaggaatcatctatttgggggattttgcaagcttttcctattctgcagccaatggcaactaactcagtcaacccatttggaaagaaagaagattcactcttgctgccattcatcctagccactcagggacaaagcagacataacttccttctcctggagcatgaatgaccgtagaactggccattccttaatgatatggtttagaaaatggagccctgattagaggggcatttttcatcatgctgttttcactttcctgctctagttggccatgaacaaacatatatcgttagaaagcctaaccaatactttcccggggccaatcttctaataaaatgacagtaaaataccctcccgtggcatgattttaaccataggttcattataatcacttagttgtgaaacaattgcaaattccatttttacaccaaatttttcagaggaaagacactggcatctgctttgattcatcagagcagagatcaagatcatcagtattccagtcctcaaatacgatctcaggttcaccttgtggtaggcccacaaattccctctaaccctggttgctcattttttttttcctgctgaactaaaggcctgagatagaaatgcatagtttggctcaatgcaaactatccccatgactggacaaaccagttcaatactgacagccatgccataactccatgcaaagagaaaactcatccttgcatatacatctttcagtaaaaagtaaaatacttatatgattacatttctcataactttcaactttattcctgaatccattgactttcccttgttgctaacaagttgacttcctattacaagtgcatttcccacaatctgcacacttctcagaaatgtctagaaaacatctccatggtctgctgtggaaagatgaggaacatagaggtttctatacaaggtaccaagcccagcagtgctttagggagcagtgtctcctacataattacattgtcaggggttctagaacagtttgtattgaccagtcccatggacatatccttatgctccctggcattgtacacacaattttatatttgcaaaatacttgacggagggtcagtaacagtggttatcaaacattggtatgcaaagaataatacagtatggctgttgtatagctttcatgagagtctccataaaggttaagaatcactgcttccaaaggtgctagttaatgggtaacttccagaaatctcttagggattggcacccaagcaaacacagaagtaatatcctgcccttgaagactctgttggtaaatgaagattcacaatgaccaccacacttgtcacttgaaatttaccttgctattgctattatgaaaatatgacaaacaatgaatatttgaaatataagttatactctagtccctagggatatataaatgaaatttttactaatgtaaaccagtcatgtagattactataggcccacagtccctagactagatttatattaaaatagcaaaaataatcacctgagtaaaagaaaaatgtaggtcagtattgacaatgcttccctccccacatctctttctgttctttcaggctcccatggttctaggccatcagatgggaagtacaatgaggcctgttacttccaaggatgatgagaaagctgaggaaaccagtaacacagaaacccactggtccacagaaggaggttttcacttacagagaatctttacacactgttcaccagctgatttgaaaatacccacagaaagttaatttaacttcaaagatctctgaaaggcaactcatggctaggtcacctttgagcttcccattggctgctaaagttctcttgatgcatcatcaattatatattcttcatgactaaacatcacttacaacgttattcattaacgtttgcagaaccaaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtgagaataattctctttggtggtttttcctctaatgatcaggaaagggcttttttttttttttttgagacggaatcttgctctgtcacccaggctggagtgcagtggcgcatctctgctcactgcaagctctgcctcccgggttcacgccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagcgcaatgtcagctcactgcaacctctgcctcccgggttcaagtgattctcctgcctcagcctccttagtagctgggattacaggaacccaccaccatgcctggctaatttttgtatttttagtagagacagggtttcgccatgttggccaggctggtcttgaactcctgacctcaggtgttccacctgccttggcctcccaaagtgttgggattacaagtgtgagcccccacgcctggccaggaaatgactttcatagcagcaccaacatagtcaaaagtaggacatcaccatcactggcactattttgaaaagtttttatattacaattagatttacatctttacactaattaggccatgtttatagtggtcacttaggggcatgctttcaaaatctgcagttgtagcaatatcatgttcaaatgcaaaacccacattcacgaatcagcaatatccagctcaccattttcttgctttaaaaatcaaagtatccactgagaaactccctaccctagagttggaaattgcgggttcaaatctcaactctgctccttacaaatggcatcaagtcagttaacatctttgagcctcagtttccttatctgctgatgggaatgtgtcaaaaaaatttttttttctttctttttttaaagagatagagtctccctctgttagccaggctgcagcgcagtggcctaatcatagctcactgcaacctcaaactcctgggctcaagtgatcctcccaattcagcctcccaagtagctaggacaacaggtgcatgcaccactgtgccttgctaattttaaagtatgttttgtagagatggggtctcattatgttacctaggctggtctcaaactcctggcctcaagcaatccccccaccacggcctcccaaagaactgggattagaggtgtgagctagtgtgcctggctcccttttacaacaaaaacagagtttgttatgaggatgaaatgagacataatgaaggtaagagcaatctagttcatgacctgctcagtaaaggtttgaagaatttgaataatgatttcttcatataaatggttagctaatccatgcctctgtcccctgagggcagagaggatgataagggaggttgagaaacacatgttcagcactttgggctatggtcatgccaagtctaaggcagggatagtacaacaaaggtcacagaacaaggactgttttctgacgtttccaactctacactgactttctcgtccaataatacagtatcttgcccatgttactgcatcacctttgaccctggagaaagaccacagggtgctgctcctggctgccttaccgtcataatgagcttctccacgcagtcaggtgccacgctgtggaggtgggtgaggtgcagctggaggtggatcttgttgttgagcatgtcctggcacagggggcagcgaagcatgggttgcaccgagtgctgcgtcatggcatgcacccggagccggttgacatcggcattactgtacttgcagtagggacactggtacatctgtggggaacacacccactgctttgagcaactgtgtgtgccccaagcccgcccacccaaaagtttgttccctaccaatgtctaaaacacctcacctccccaccagcagagtcccttccagcctcacctgctccggtttgatctcctcagctgtttttggtcgcttcgaagagaggggagactctgagctacctgggaaggagatgcgtttggaggttgcaggagaatctgtcagctccttctctgcttggctggacgatgctaaaagagaaagtagaagatgcaatacagcagccagaccaggccagctcccagagggtttgtgttgggtgaaaatcaacattcatttatagcacaggattttcttaaaacaccaaaattcaagaaggatgaacatccggactgatttatcaagcatgttggaaaagaagcaagtgtttctttctcccccatgaatttctgtcactactttaacaactgaacattaggaaaagaaggcaaagaaatggaataaaaggctctggagttggattaagctaaattcagtctgttctaacctcccccaatctagatacaatctgctggcttgtggggggcagtagggctgagggtgggtgggaaagtctcaccaattgctttgccagcctcagtaccagacatgctctgcttcagaaatgtaagaagagatgtgctctcaactttattgtccctcctcttggaatcacaacatggcacagcattggcaacatgaaaaatgtgatttgagaaaggttcacatgagtatcagcacaccaaatatgtgggggaaaaaaatcaagtttgggttcagcagtttgcttttggggaagaaataattgaggagtggaactaggcagggcctgaatccaagatataatctagccagtgctccagacccaagagtttattcagagtgggtgggaatagggaaagtttcctatctgcttgcccaaaccatgcctccatgcccctcttgcttacaccaccaaaaaaaccaaacgctatttaaagaggagtggcccatgaggattgagcagcagacagcacgtacggaagtgctggtgggaggagttctctgaaggatggaaaggaaacatttctttatcttctctatttttaaccccaatcagtaggcattaggttaggctcagggtttatagttaggaaaaacctgctatctgctcctccttccagtagaggcaaacactttgataagaaaacagccaggctaagggtttatccaggataagcaaggctcctccagcttaaacacagtatggttggatctggttgttccataacctggtcaatatctgagtgttggctctttcatttgttttgaatatgggactccatttttcagaattttgtttaaagcaataagaaaaaaaaagtaataaaagtggtagtgagaaaatatatatacccacttccctcatgaaaaaataatgtgactcagcattcaggtcactgaattagaaagcccaatttttattccctgttaaactgctttctgttttaccctgtctagttatctggcatatatttccatttatgcttgggtttgaaatttgttctgatgtggacaccaagatgctgtcattactttaataaacaattttagacaatcaattttattcattaaaatcataaggccacaatataattttgaaaagaaatttgccaaatgcaggaaatatattccaggaagttgatgctcttcccagagtgcacatcttgtgacctttaaccccagtatcttggtaacctggtctacataagtttgtaggacatctattatttaaaaagtacaaggacgagcatattacacacagatcctcctcctcccaacacacacattcataacagtattttaatctgtctcgaatcgacttcaaacccattttgctcttaatgggagttattcattttcacttgaaaggtaatacatgacggctggatgtttaatgtgatggaatggctgccgattaactaggtgctgcaacattctagaccagttcccccatggcctacttcccatctcctggccccgctcagacctgatcctatggaacgtcgcgttgcaggtttgagaccttgcagtgtgatgggccgctcctgaacacatctacatttggagtccttaattaatgtttcaggaacttaagttcccttgcccccagaaacttccttattctccatcattttgatttttgcttagtggttatcttctatatattaactcttcaaatgcattctcaagatggggtgggtgagggcatcaaataatacttccagtgtttatttgtcacagccatttctttaccttctctattgtgaactccaatcagtaggcattaggttaggctcagggtatatatagttaggaaaaagctgctatctgctcctctttccagtagaggcaaactaagacatagattctattccatacacccatccccatccttttgttactctgcctgactaaaaacaacacctgttttacaggactgtgactgccttgtaaatgccctcaatctgcctgccccctactatggaatgagtcaattgtgcacttgctcaatagtgtggatgaatgggcaccgaggctgagaccacccgactcatctcactctcccagagctgaaaagcaaacacagtaacccagtgcagcattagtttcctcataggaccaaagagtccatcctcttccttgaatgctgaacacatgatgaattgtggtgaggttgcagaggtgagaattctggtttcagaagccactattctttccccctgcatggagaggggaacttcttttttttttttttttccaaactcaaactgctctggaattctaaagcttcttttgtgagcttgagctaaggacccattataaagtgttttaaaaaataaaatcaccaattgctcactcatttttctttcttcccagtgatacaacagccctgctttaacatgaaatgctgcatccactggtgcacaaacttcaggttcatctagtttctatctaggacaatctgcacctttattagatcaaatctgtctagaagtggatattagccacctgcagctcactggccccttctctaaagataaagcaatgccatccttataacagattctataaacacccagttacaatctcattgtgtttgcctgagtgatgtggggatggctcctaagagttaactatggctgacacatgcccctcccttgcttgacctcagacattaaaatgtcagtccctatcaagacatcgtaccaaagtcgttacaccatttctgtagatgggcaaacagttgtgcaagttctggcaaggtgcagtggctcacgcctgtaatcctagcactttggaaggctgaggtgggcagatcgcttgagcccaggagttcaagaccagcctaggcaacatggtgaaaccgcatctctacaaaaattacaaaaattagccaggcgtggtggcaagtgcttatagtcctagctactcaggaggctgaggtgggagtatcacctgagcctgggaggttgaggctgcggtgagccatgattgtgccactgcaccccagcctgggtgacagagtgagactgtctcaaaaaaaaaaaaaaaaagagttgtgcaagttctccatcaacatgctatgctggatgagggtttatcacagaccacagtcagaggttctctcaagtttcttctctctgaacagcttcaaaagggccagagtctcagaatcaatttctacttcagttctgtcactagcatacatcgtgggcataagtaaatgaagttgtatgaataccaagagagaaagtactgtggtttctcactttgaaggcttttctaaacttaaactctagaagacatgtcacaatatacaaaacacttttaaaaatcaattactggtcactttaagcctgcgatgatgtcacataagtgaaatggaaatacatgcactccagagacaagacatagtttagacaattggtgtctggaacctttggtttacatcggcaacaaaaaaacaaacaacttgaagcgttagtaactctagtggtttgtacaataatcacaaaatgatttggaaacaatctagatatcttacaatagggcatggtataagtaaacaatggcatggccattctactgagtattagaagacattaaaactgattgctatgaagcaatatggaaaaatcattgagaatgcaaatcagaaaagaagataaaatgtgtattatcccatgttacagctatgtaaaaagtaggtattagaaaaaaagactagaagaaaatgatcattgcctttaggtgatgacatcatggaacactttaagtttttcacatagtcattttatttttaatattacagttatcatttaagttcaactgtccatgaaaaagttggtattggctctatactgtgcaaaacatcagatggtattttttactttgctggtaaaagcaagttctctcattttggcagttataaaatatgaaaatatgtgttaaatctcagtgaatcttccataggcaacatgttgggctcctgggatttcaaaggggataaaaatgtggtaaggaatcatgcgactgaatgcgctatagatgacaaactctataaagctaggtaaatgggatattgtgacaacgaaatgctgggtcaaactcctactcaaacttaacaggacgtgagctatggattccatgccacacagactttccagggagtgagaaagcacttgctctgcttgttagtgttatggtggccctacccaacgcgtgctgatgaggcacaggaaagactagcatgtccctgttatggagttcagaaaattcaaaagtcagctctctgggccaacagccaccacttctcctcattctgtgatgagttggccaactaaaactcacaaagacaaatactgagagaaacaaacctgttcatgattgtctattttatcctcttaggctcctctgcattctaggcaaaagaatttcatttcaaagggaagcacagttgtcaatacatggctcccttagggggaaaatcatttatgcatggagacaccaacttccagatatcctttgattttatcatatttgttttagaagtattaaacctctaaaaataattactttaaaagttacccctctactcatgttagttagagggaatagggaagagagctgataagcattcatgcaaagttttgtttggaatttgcaagaaatggttttattacgttgtaagcatatagaataatgaaaatatggctagcaaaactttgtgtaggaagtgacttactttaaggaacagtatcacttagaaaacttgtcaagtggacaaagatggtagaagcacagcctttcaacattcacagtcccttataacttcatctgataaaaccattcttgctagaacaaattctcatgtgatcccaatctttgctaacaaattcgacatccgaatcactgaaattctggccacagaaaacttaagagttgtgcttgcaatcccagtggacttaatgccaacacaggcttcatttctcatctagtaactctgtacaactctgaagccaagtaaggcgtggagttgctgcttcatcaaagataagcctgaagaaaaactggaaatgaagtaaaacatggaaccttaaggtccctcattttcaagatatccacttgccctccaagaaaaccaacatactggtagaattagtttctgtgtttcctaagcaaaattcatcttctcatcactaaacacaccagtgcgctgttggcatggctgcatcctacgatgcagaccattctccctctggccagaggcctccctcccttggggagatcctgggcaggcattaagctgtccacgttactgggaagtttcttttgcatctcttcatggtggagtgactcctggaggtggtaatcaccgaagtgctgatcctcttcctttttggcgtcctgaggtgagcccactgagggtctgggatgctgcctgacacttgaaccttgtggggaatccaaaggcagccaccacccccacctctcaaccatcagactcttagctaaaaagtaccactgacagcccctccatctaaatttccatctcccaaaccagcaacataatggaggagccaattaaatgattattaattcatgctactttccgtaagccagaggttctcatcgccttacattccgtaaaccagcttgccacctgccccagaaatttacagcaatcttttctctatctccgttgactagcgaaaaaagaaattcacatagctccatacttaatgtctgagttgggataactattccaacacacaagacacagatgtatcaccagatctgaaaatggtccttcagctcataattataattaaatggaaggtgaaatgtgtgtttcccatagctcctctctctcagcttctcatacctcatgctcccactagacagcagaaatgcaatgtttccagagggtcatctgtgcttttggattttgtgatctgactttcattgaaagtagagttactcttggcatttgcttgcaattccttccccagaggacaggctgggctttcttacttgaatctcctgtggagctactgcacttgataagtggccaaagatctagctaaattttcttcctccccccaatagagagaacaacagttcctttaaagaatctgctttcctgccaacttggtctttaaacatgcatggtctcattctgcctccaaccaagcacttagagatgtttccaagaggaataggggaagaggggaaggggatttgtgtgaagcagatgcacgcacatgttcactcagcagggggcggtcttcaggccacagctaaaaagaaactgaggcttctctcttccctaatcaaagaagcagaatctgtctcaacatccagcctggtgaagttaagaaccttctattcaaaacacagtcttattctaaggaaatgcaagctatctcgctcccgtatatccctagaaaacacctacccctaaaagtagaatatgcttacaaaggtatggcaagacacagaggttctatcaacttcacaggccttttgtttctaaaaagggtttcaaagaaaatttgatttatactacacataggtataagagttactcagggaaaggctatttttcttctccaacttaaatatgaacaaaataggtcagcactttaaaaatccagcagctcttagttgttattattacgattttactttttgtttggaaataattatagcttcacaggaagtctcaagaacagcatagagaggacccatgtacacttcacccaggtgttacttattaagcagtttagataaagatttccaggtcttccatcactcttcatcgtgaccctgcctctccggctccctccctccctccctctcccccacccccaatcttgcttacatctaccaagacttagggccctatgcctgtcatacaccttccctgtcctttaggaaagctccatgcctccctaacccagcaagggctcaggacttactgtctagttaagaagtcgatctcaaaacctcacgcttgtcactgagatcgcagccttgaggttcagcaaatgccagaatgtgtcagactcccgggcagggctcattaaaacacagatcacagcccctgccctaaggttctgattcagtaggtctgagtcagataatgtacatttccagtaagttcccaagtaatgctgatggtccagggacgacactttgagaacagtggtcagagccaaggctttgtgtaataggtaggaaccacgctgctttgtggtctaactagaaataaatgagagggcccagcaagcatgggccaatctgtcagtccactttaaatggctctgatgacatgatactctcatctaaactcagggatgacagccaggtttggtctcatagcctagatgttttaaaacaccctcaggccacctgcttactctaaaacaaatgcagacaccttcaaaaccagaaattcagaaggaataagctccatgtgttctgttagcgtaatccagaataaggacagacttccttgtttacagaaatctctttctttccacatgtcctgtcctggagagcctctgtgaaaagagggcaaatacctgtgggctccttccaccttgcagaaagaggaagcgtctttttagtgctggcttccctcggtcaggcacctgcaggcctcagcagctgaaggccctctttgcttcagccctggaagcatgcacagatctatgctagcccccatttgcacaagtcagcaatctgggaatgggggttcaggcaccattctgtggggcctctgctttctctgcaggaagcagcctctctggcaggctctggaagcctcaaggtgggatggtgggcacacgctgaccggtgggtgctgctgcttgctctgcgtattttgggagaaaaatagtgctaagccctacatcagagacatcaatctgttgcactaattccttgctgaagtatgcataaggctgcttaaccacactgatttgagttcccaaaaggccattccacatttcaatttcaagacaccttgctccctctgtgtcaggtttgcaaatgaaccaccagtcaaaacagagccaccacctggtttagaccaacatcagctgttggtctgtttaataaattataggcactggactgccaccgtgagcccggctcatgccaggatttggaggcctgctaaatattcctgattttgattttgacctgattcctgactttgaggtactgagtcaacctgcctgtctttggcctcttgttggttcccccaaaatatgctgtcttcccctggcatagcttactgcagctatggccatggtatcttgtgaggatgggtggccacagtccagggacacactagggggtctgcacttattacgcttccctgtggctttattacaggactgtgaagacaaccagagtgggaaggaacctcagaaacctttggaccaacagaggaaaaagcccagaggtgcaggacatagatcaaaaccagtcgcatgcgagtcattctaggatccggccaaagttaattaacagagggccattcagtctccaccgagtcaaacaataattaggttagttagggtctttgagccccaacacagtctagactctgagacactgcaatataacaatattcttctggtttcttctccattccaaatctatcttcctaaaatactaaattttaagagtgaaagtgaacttgtgaacataaacaggtaaaatgtgggtgtgtgtccagaatggtgacagacagggagaactgctgaatataacttatcagaaccttacaaactggccttccctcatgatccacctagggtttctttttactagtcaggttccacaggaaaatgtgagaacttatacttagggaagaaagacattactcaggtccctgcaaggctggaaaatgggaatgattctccactttcccctccagatttaagcactacaaagactgtcaacatctcttggcattttgtacagtacagagagatagacaccctacattgtgtaatgtttatatttaatatcagtgctgctttccgtctccattgagttcccacattcagctcactcacagcgctccaaaggcctaggataagtgacctgtgtgaagacatggggaggcggttctggagcaccttcaggtactcctcaggaactgatgttttttcacttgttgtttgcctaaggccaagttctctttacccgaaggcatcattcagccccccttgctaggtaataaagcacaatattttgtagcgctggtcacagttggttcacatcctggctgtgtgacctcgagcatcctatctgactacactgagctttctgtttcctcatctgtcaatgggataacactgtctacacatggtttctgtgccgctagccagagatcaggcatatgatgcctaccacagagtctggcacatagtgaaagcgcaaacatttgttgctatggtttcttttttagaaggattgggaaataatactgctggggctataaaaccatagaacgaggggagaaacttgtttatttttttgtttttatgggctttccaatgaagagcggaaagcctgctagacaaattctaaaagctgtaacactgaaacttggtttttaagacaagcaaagacaccttaaatttgtcttttctctataccaggatgaaacaatcctattaacccatggatttaatgtctacaaagcagaaagtagaataacttggacttaaaggtacttatgtcatgctattttaccaattgattgttaacgaaacatctaaacagtattaagcacttgctaggtgctggggattacaaaaatcaatggttgccacatagctcctaaccataaacagctgacaaactctatctgacaacaagagaagcatagaatttaagttctcctcctccaaccttcctaaaagtagagaaagtgataatgttacatgttctttggctttataatgtagaaaatatatctgactcagaaggcaaattgggatttgactgcaactctgacacccgagttcccaatctgtgaggcttagttctcgaggctgcaaaacgaaggtagcattggacccaagaagaatatgagaacctaatgaacgtgctctaatatcccccatggaaaggcacaatggtattttttttaaataatcatgattataataacagaggtactttacaattggcacaaaagttaaagctggaacaaagcaggcaagattaacatggccactctgtaagaataatatgcaaatctataaggtattttctatagtgatgaacaatgatttgctccttaatctacattttcactgccctttatctataccttgatgatagttctcattatactgtgtcataattgtgattacatatgacaacacttctagaaagtgagtttttttttttttttttttttgcatgtcctgtacctgccttagatatgtgtgcaagaaaatatttgttcaactgatgtggtccctatctctcttatgacttacaacataaattctcaaagccaagacctttgaattaactggaatttgggcaagtccagatatacaccacagcctgtatctattttggcttcccaacataaaaatagttcatgatttgttttcaattgtgagacagaattccgcctgcagtgactttaagcagccaagtatactgaaagtggcctggaaaaaaaagagtggggagtgagagaagggggcacaagctgactctggaaaaggtgacacagtcacacaattccaatctacgtgtgaaaacataaaaccaaaaatggtttccattggcaggaccatgaaccacaaaggggccacgcaaaatgggctcccagtattccctcacatgcatcctactgcaaagacaaatttacttttgggtgaggtggagaaatgaaaccaagtaccagaaagatacagagttaggccaaaatgatttttgtagaggtatggtggtggtgttgaatggcctggtttctagtcaacaacagggttgggatatgagtggccactcaaaggcacccatgtgagtctccaaggactcctctgttgatgtcctcatcacactgcctctgacaacacagtgtgtctgtcccaagaacacagaactaggtaagggcatatggtgctcagacattccatcaagaaaagtagccttggtgctgcctgacctccattgagaaagccttgagccttttatccagggtatattaactagccacagacaagagaaatctgggaaagttattagcattccaactttagtaattaatatgctccaagattctataatgctctacaactgtccctaccccagtcataatttatgaagctccagaattgttaataacccatttggtccaacctgccactttacagatttggaaactgaggtccagagacctcaggtcacgcaggtgaacttagtggcggaattaggccttgaacccagggcttctgactcctacgagtcctgtatttttcctaacacgtttcctctcagcacataccttcttttgtccttagagactcaatttggaaaaacgaaaaaaaaagtattttttcagcccctttccattctttgtcacagattatatttcaggcactaagttccccatacaaaggcatctctatttatacaaagctgtaaacaacagggaaaacagggggagggctggtaatagatttgcaccaggatgtgcctgacctgctttttttcaacctcagtaattagaaaggcagcaggtctgtaggaattattcatatgcagcaggagccatacgctatacatttatgttaaacatgtcaaatccgattggaatcatgcctgccagcaccatattccataaacgtacttttccctaacagtcacccagaccttgccagcccattaatacttcctttaatagcaatcttctatagattcaaatcagggacgctccactgcactaattgctgtgttaggtgagcatcatagatttaaaaaaattaataaagtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattaccttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaaccacaaagttggacagtggcaatggctgtgcattagggaagagaacaaagaaccttcctgtacccttcactggcccacaggagtacatcacactttccttgacaagatgtgcccgcaagggcctgttcatgtgctaccactcaccctcttggaactctcaggcggttgggactagtggatatcccctgtccatgtttcacagaggaggtacctgagccgaaagaggccaagtgcctcaatcaaggtcatctgctggctggtgggcttcctgactccaaatctagagtctttccacatcaccatcccgctttcagactgagcacaacgccagctccttacaagacatatatccatggttgataatccagttcattttgaacatcctggtggttatcgtgttactatgatcactgtacaatgtcaggagactgctactccttatacttagacatagatgaaaactagatctaatgatcaaactgaaaatgatccttctctgagagatggtatattggtaagagcttgggctctgtcctaagttagaataagtgcaaaagccagtgtgtaaatctgaacctgtctgtataccttttggcgatgtgctagagattcttaccttcctttttttcacatcatggcacacacagaaaatgatggcaaattgggataaacagatgaagcaggacctgtgtacctgtgagcaattcatggcatgcctgctgggaaggacaggtgtgaagctctagaatggtgcctggcacagggttagagctttatgcagccgttataattaccagaaagttgctgtacctatgatgcattctttcagggttagttttgttcctttggggtatctatagctgcacatgtggctacttaaatctaaattcattaaaattaaatacaatttaaagttcaattcctcagtggtaccagccacactttgcaggctcaatagccatatgtggtaaatgactatggtattgttcagttcagatgcagaacatttctatccataccaaaagttccattcgacagcactgatctatagtaatatcggtcttacgactacgggcgttcctgaaatccccagaagaatgttagattccctgaaggcaggccctataatctcactgaatttgtgatcagtggaactctgcccagtgcctcgcatggggtagggactcagccattgatcgtggaattgacccaacctcagttcagatcactatcttgcttgctgtgctgccacccagggtaaaagacctgacatctgaataaaagaatcccaaagaggaacccccaaaaaggaaaccaggaggcccactccaaatgtagaaataaatagctgaaagtgttcagtacagagtacccattcctgcacaaaccccaaaactacaaaatcagtagctgagaaaatgccaattatccaggcccatctgaaatattattaatctgcatcatgaacagccactaatcaacataacagattgtgaaatcactatttatttacttgccaggaggaagcattccccgtcacatgtaatcagataggaacagctcaatttagggagagaatagaacaaacgtagttttaaaaatatatataaaataataaggatccagaagaaagctcagaggaggttgctggcacctgtatcgattccaagatcaaatcggcccaagtaccttaataaagcctgtcattacacactcagatactatagacaaaattatgcttcggatcaaaagaggatcatttgcaggagtcgggaaagaattttcccttctctctttactattgtgcagctggcaaggtgcatctctgagttattcattcaatcactcattcattcattttctctctgtcttttggaagtaaagattaagtaggcctggtgcttgaatgaatgcatgagaaagtggaaccttattaaggacattcattttttatggtgctcattttacgtcttttagtagtctcctgattgcctagcatgtccactagtgctgtgaagacacactcccaatgaatcagaaacactctgagtaagatttaattgaactgctctcaacaaaggctgccctaaactggttggaaggattagagaggcacatatagagtggctagcataaggcagcacatagagtagggactttgcaagtggtggctcctgtttattatttccgtagtgcccttagcacacaaaatgcacgaaacatacgcaccaaacatcattcgcacgatcccattaaatgcttgtatgttgcttctccctcagctcaaaattcccaggagccacatgctgccttgcaacagaggacccaaagagaaactgctaccagttttcctcatcttatatatcactaaaccattaaacaaacaaacaacttacatagagcttacaacatgccaagcactgttcggagcttcccatagtcaaataatcctcgtagcaatcctacagaaataggtactatttttaatcttcatctcatctgaggaaaatgaggcacagaaaggtcaaggtaccttgagtggggtcacacagctaatgagtggcagagccaggattagaaatcaagcacccaaatcgtgacaacaaaggacagatggctcagaaggtcacccagtcttcaaactgtgtttgtgaaatccttttccccagctcacctggcgatctgtttaattgccgtgtgaaccatttgtttagctctcattcaacgttgaggcaaaactgggatcttggtccaggcaaagccccacaggaggatacgtcccccactacattcagggccttcctttgagcacagatgtccatcctccactcctcggtcctaccttacacatcgcctagggtgtttgaccctcattgttttctggagtttaggcttctggacaccacacaggccagtctgaaggggaatgctaagcacagtggacagtagaatccacctggtgtgctgcccattcattcggctgcagtatggccctctctgtgtctcccaggaaacactgaacagtggtacatcacccgccctgcgtatctctcccgatatctgggaactattgtactacctctctaatttctcttttctaggctgaatgacccatttcttcagcctcctctcaaaggcaatatttctcagcccttcagtcattttcattgctctcttctggcctctctccaagattctgtatcttgtttaaatagtgaagtccaacaccgaacatgatttaagaacagtcatgcctggaaaagtaacaaaggcccaacgaatacggactccagaaagtaaacattttctcaaaaacaaaagtattgtaatattaataatggtagtaagaattaggttgaccaaataaaatcatttttgttgcccgtcacatcatttcctcttattattttctagaaggcttaactgtcccctaagtcttctctgaaatgactttgctcctcctcaaaaaccctaagcttttttagtctcagctcttcttcccctcaacatagaaagcttatcatcttgagaaatggccgttctccttctctcaacaccagtttttccagaaatagcacttcctgtcttggcttcttcaatgtcttctgctttgggtaagatgtccccctgcctggctgcactgcttgtctcccctttgggtggatttcagcacatgagtgctcaccctgggggagggggaggacaggaagaatatgcagggcaggcaccacctgtgcagggccctgcccaggcccccaaatgcaggacaaagaccacccttcactgctgactcccttagtaattttttatttttattttatttttattttttggtcacccaggctggagtgttatggcatgatcttagctcactgcagcttcgacctccctggctcaagcattcctcccacctcagtcccccaagcagctggtactaccagcgtgcaccacaatgcctaattttttgtagagacagtgtctcaccacgttgcccaggctggtctcgaactcctgagcttaagcaatctgccgacctcagcctcccaaagtgctgggattacaggcgtgagccattactctcagctgggaatcttttttttttttccccgagatagagtctcactctgtcgcgcaggctggagtgcagtggctggcatgattagggctcactgcagcctcaacctccagttgagggttcaagtggttctcccacctcagccccccgagtaactgggactacaggtgtgtgccaccacacccagcattttttttttttttttgaattttagtagagacagggactcgctatgttgcccaggcaggtcttgaattcctgggctcaagtgatcctcccacctcagcctcccaaagtattgagattacatgagccactgtgcctgacccttagagaatcttgaggctaagaatcaggggtgaccctgatcaagttccacatgacaaatctctccactggccttgggagcaggtgggaccagcgactggaccttcaatagaggaagaatgacatcaagggcattttggtgaagagccaccaaagagatgtgaccaacacccagatgcccttgcacacagcttggcacttacctggatactcaataagcaagctggctttggtgccacttaaaaagcttaaccattaaaaactacagtataatgtagtataataaagaagaataaaggtgactgctcaaagaagcaaacgaaatctccctcccactcatcctttttctgggcagactaaggatgtatccgctccctgacttgttagctccattcttccagggaaggaaagatgagaaggctcaaggacagccacacacactacctgtccacttgccctggtctttctcacctccgccctcttggtccttagcaagctcctctggatcagcagctgtttcactgggtccttcaacatcttcaatggcttcttctgaaacagaagaaaaacatgtcaagggttaaaaataaaaagaagatgaaggacttttggcctctgttgcaaacaactgccaacgacagaacagacaccaatgactcgtcccccttctctttccagaggcccctgggagactgacggtgctaaggatatactgaggtctgggtaagcagtggggactttccttctgggtaaacagttggtatgaggttgtgactcgctccagatgtgtggccattaggtatttccagatagattctgaatgcttcgcttgagtagttctaactgaaaaaccaatcctggttgaagcagtaactccacctgaatccctgaagttgcatgcaagtcttttacacttgaaaatgcaaaacatggccacctgttcacttcatgcctagctccattcccaaagcctcctggtactggcctagaccagccccagtcactgacccctcacagggctcacagtgcctatgcatgtgccagagtgtgtgggaattgttggaagtcatgcaggttgcgaagagtcacagaatatcagtgatatgagttcatcagtttgaagagttccagaaaccaaatggtatcttgtgaacatgccaggaggcagtggtgggaagtgagatttgtagagtaagggataaaaatttgtaacagagtcgtacactttctttttgaagcaattccatccttcactcactacgggtttaaaactaatgcaggaaacctctctccagttcagtacacagtgctacagtgaaggcagaatgacggctgccaacgctaggctgcttatgaagtcaaatgtcgttcagccaagtggggaagaagagaataagatactctagatgctgagggaaagaaggggagacacttctctcttgctttcctggccctccgaaacattatccaaaacatgcattcagtaagagtgggctaagggaatgaataaagtggacaaaccaaggtgaaataattttaataaagatgaaattattaggaggctgtgaagagcacattttctcaggtacacaggcgtgagggcaaggatgcccacatctgtcagcagaccagaccccagcaaggaagtactgggtctggcttagaacactggatcaggcctctatccagcaccgccagaggtctgtccaaccccaattcaacttttcagtattttaaagtatcatgccttctgaccctctagaaaacagcctctaccccaatgctacttttccatttttctaaatgtcatgccttctgactgtctagaaaacagcctctaaatgtatctcacgaaggaagtaacaggagtacaaagtaaattggtctcaaagggtttctaaaacactgaggaagaagatgtctatttagaatcagattgtcttgactcaagagatgatggaggtccaaggtctggaaaactgaactagtgtcacggaacgttctttcttccttaccaccaagagggagtttatgaggcagtcactgggaatacaggtgaaatacggtactgtttattttcatctccaactcaggattccacatataatttctctgtctccttctttgtctcactgcacaataaagtcaacatcaagtttccctaccctacccttagttcaaacagagaaaaatcaggcaaccacagcttgaagtcaatcagatatagagccccacattgacaccatacatcatttagtagagtaaacatgtataggtgtcagtagagtaataacaaattacacagcgtgacacaggaactatcttcattatgtccaggtgggacgttctgtgcacatttttaggatttcaataaaattgttcaacactataatgataaaattcatctttgaatggtgataccagcgtgcggtcaatgaatattattgcattcggtctacccagatgagctaggtcccttaaaggacccttatttgtcccaatacatgctgtgatacaaaatatctgtagtgttgatacatttatgcctattgttccattattggaacactaagcttgtaggagttatttatatcctactgcccaaggtcatcgccaaggtctgatttttcacacacaaaaaatttgcaatctccagcataaatgggataatcaaatttgattaggcaaagagatggctcaatggcctctcatctctagtgcatacatatgaccaccttagatgaagacagtctgatacctacaaactacagaacaccctgagatggtgatgtgcagtgtctgaaggtgctgctcagcagacatgggaagggatttacccactggggggccatctccaagccagcacattatacagcctgcagctatcacagcagagcactaaaaactcacagtcacccaacactgaccccaattctttgagccttaccaaacaaatctgttgagaaactagagactgtaatgtataagcagatcattgatgcatcaagcatggaaactgcatgttgctttgtgaatattcctggagctctcattctgtgagcccacttgggcttttgctttcttccctccctgccctactgcaagcagaaaatgaaggcagctgagttccgatgagaggatcaacgaaagaggttatttcaagaacttattttgcttatctctttttttaaaaagatttacaaatcaagtcctcttcttgagttcctaggtttaatattatcatttgtgattcattcactaaaaggctgttctatgcgtggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagttacaccatctgtctttataccatcatcatcaacagcaagaggaaaaatagctctttaaaatggatgaaagcccaggctgacagtaaccggaaaactgtgagctctgaataccaataaaggtagagaaatgattaaaaaacagagatgcaaactgaaaatttgtctggacagctcaggcccacgatgctttgcaggcagggtgtgttttattggttccgaaagcataaagcaagctgcttaccaagagccaggcctggggaagggcttggtctcccggccctggaaacacgtgggaaccaggggcaaaatagcatcccgctttgaaacagagatctgcgtccacacgctaagctcctagggctgttatctagcccttgttctctttaggaatgtagatttgatacacacgtgctggagaatggaggggaggttttttgcttttccccccacagatcatggattgcattcccccctcttctgcgaagtcactggtaactggctgggtcattattacagaggctgcagatttttttcccctataatattagctactgacagatggtgggaacaagtgaagacctgatggactgatgatcggttttatctggaaaatcctgtctttcctacagaaaaagagaccaagacacataacagccactgtgccatttttaaggctgaaacagacaaatcaaaaccatcttctccttcaagcatttaatggtatttccaatcccaaccagagcacaccaggaatgctttcccaagggcgtggccaggacctgggagagaaggtcatccccactcccctagtcccgccctggttctgggcaggaggtagcaggcccaatgcctcccagacagctctgtgttttagaagacaccagagaaggtgtctctaaaacccatacggaagcccacagtagcctcaaactggagcaccccctcctgtgtgtgttttcatgttaaagagttagggaaataaaagcaaatactggaaaactgcagtgtcttcctagggtcccttctgcctttcatttccatgttcaacagtgactgaaggcctttaaaaaacctctttggctgggcatggtggctcatgtctgtaaatcccagcactttgagaggccgaggtaggtggattgcttgaactcaggagtttgagaccaacctgggcaagagagtgagactccatctctacaaaaaatgcaaaaattagctgggtgtgatggcacatgcttgtagtcgtagctaacttgggaggctgaggtgggaggattacttgagcccaggcagttgaggctgcagtgagccatgactgcatcactgcactctagcctgggcaacagagtgagaccctgtctcaaaaacaaaacaaaacaaaactctttccatcaccacctcctttttacaactgcttctcccagatagcacttacttactagtgcctggcaaaatccagcctgctcatcactcaggcttcctgactaagtgcagagccctgaagtgcaagaattccagcagataaataccttctaaaggggaaagcttcctaggacagcttcagttaaggggatgataccccagtcccagaaaatttcccttcaatcaaagtggttttgctgaccacaaatgcaaattgatctcttaatataccttatacttagcatcttggtaaaggtgactgcacaattcccccatcggtggtgaaatctgctcctgaaggaggagagcatgccaactggcagccccatgggaatttgcaccaatcttatgaacaacctggaaattggttcgcgaaagcagcaccaggcagaagccaaaaatagaggtggcatcaccacaaagccagcattcaaccccgcaacctcactgtatgcactccccaaacgcatcacccaagaaaatgttctagctgtttaaaaaagaaaaaaaaaaaggtactattttcccaaataatgggggccaagtgacgtgtccacggcgggtattctacgaatcacttataagcttgaaggaaggggagtcaatcaatgattaagactagtccctctgttcctaactcttaacaggataatgcagattaattcaaaccttccccaaacctgacaaagcccccatagtgcctcagtgtgacagaaatttggaaattctcctaagaatcagggtatctgtacccgaggctctcacatgatcatgttacttaaataatacaccaatctgtgatccccgaagaatgaaattgttctttcctttttctttggagggtgggatgtttgagggtgggggtgaaataaagtgcgtttgcctgtcggcaggctcaagagctgagaaacattagctgtcatgaaccacaatcaaatcaggtttgaaatatttagcagtggcttggaaaatgcggcggtgcagctctgacaggcgagatgtgcacagacacccactttccattataatggaaatatcaggcctgttctgaatatgtataacccagaaaaatgtattgatttttcattcggcattaaaaaaaatgaaatagcctgcagctgtcaaaagccttttgttaaaagctcatctttcctggaatgaggtttaccagaaacaagttttaattgtatataggacctcttctttgaaaaacaaaataacctatctgcttactttgaagatagagttaaagcttttcctttctccattttcaacctaattaacccaaggacgaccactgaagcaggtgggaaaggcggggtacactctgaccatcaagactgacacggaggatggcagctacaagtggcgtttgctggtgtctctgtggtgggtggaaggaaggactcggggatgtgcctcgctctcgttcctctaactcctgtgtaggtgcggcatcctgagactcattgtataccctgaccaatcacttgtcttctttaagccttggctggcacaactggaaaacgagggcagaacactctagcgtgtccaatcctcttggcattttgttatcaatgggaaacctctactggctgcaaatattctacagaatatgcaggctttattttgcaaatacaggtcaaatcaaatcccacaatataaaagatgactactaaggcctagaccacttatttcaaataaaatccagtgcgttataattctgctacaatagaaacttttaacggaacacaatctgcaatgctggtggacgggcagttgtgttgctcccagcttgttacttctactcccgtcttctctctctaagccaggaaggaagaggctagtggtggtaatctttgtggctacaccgatggaggtgggccactccctatgccattctccctctgtgactttcgagcaagtggagtctcatcgaatagtgaccacaagtcctgccagtgactctccatgagccccaagctatatcctacctgtaccgtgacagccagacccagaatgtagcaacctactctgcaacatcccagacacatctcaaatatttactccctggttttattccatggtgttcttccagccctgacaacctggctagatgcccgagaggtaacttccaagcgattaggtcttctgggtaacaatgccctgcctcgggaattttcccttaaatcaaggtggtttttgcttaccacaaatacaaattgttctcatcacacatcgtacactcagcatcttagtaaaggtgactgcatgttctcatgtatgtacacggaaaagggaatttgccaatctccatggaagtcctctgtggataatcatctaaattaaaaaaaaaacaccaaccaactttgcccattccatcttctacttctcagcagagtatatacatttactgaggaaaacgccagatcacaagaggaagggcctgggatccaaaccagcactgatgagtgggacatattgagctaactaaccctatggtagtccaggcaggaaacctcgaaggggtgaagactgagtgcagatgtgtgtgggagggtgggggcaggagaaagcaggcaggggctctacagctggagcatctatttactcatcagaagtgtaatattttcccaccttctcaggatgtcatttcttttccaatgggcaaactccagcgcatgaataaagctcgagacattcatgcccatttgctctctgcgtgtatgataagcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgcccaggctggtcttgaactcctggcctcaagtgatcctccttccttgacctcctgagtagcagaactacaggtgcactccaccatccccaaataattaaaaaaaaaaattctagagataggggtctcgctgtgttgcccaggctggtctcaaactccccagctcaagtgatcctcttgccttggcctctcaaagtgttgggattacagatgtgatccactatgcctggacctacaaactctttttcacatggatcctttaagtaatcattttaccacaagaattctttttaccactagatggtcatttaccaaatacacctggggccacagcgcctggagtttctggacagcttgaaaggtggtggagagctgccagcttccaagggggttgcagcagggaggccctgcaggaaaaccccacactgaaggaattcagcctccttaccgcccccaccctgaccccgttcctgtcccccattaccaccatccctgttttttggcatcaggctctaagaatcaacactctgaaagcaactctgggtattattaaaaatgactaattggagaatagagaccatttatgcttttgtatatttgaagatcttaccactgtttacagaaacaagaaaaatggggattgtgtggcaagaggcagcctgggaagggagggccaggctgcagctgcgtgttcggcccctgctgggcagagtatggcccagctcaacaagaatgcaagcctgggggagcctctccatttgcctttttactttacctcacctccaacttgagcattgacaggagagagcctgttacgagtccaaagtggccagggcctattaaggcctccccgagaaaatttcccctttcagccgtccctcctgtgggaacagcacagaacgccagagcatgaagtgaaaaatgctgccgttgtgtggtgagggacgggtcctgccatttttcctctcccaggcaaggccacttggccatttgaacaatttgtcaaaaccgcacaagaattacgggggtgggtgggggtcaagagaggagaaaaagggaggaaacgcctagagccagtattgcaacaagttccatttatctgtgttcttagcaaaagcacctgggttgccccctgcagaaatccagaaaggataaaagtaaatgtgcggtgacaaagcacaacggaacgaaatatgtcgcggactcgcctggtggctattcacaggaagattttttttttttttaataactgaaaggtgtgagttccagtttgtaaaatacaaacccaaccctgaaacgctctcggaatacacgctaagtaagaaagctagctatgtcccagaactctgaagtaaacggaattcagcagggattagttcccttggatttctacagagccatgattgttgctgttactttcacacatgaaatgtaaaaaaggcaaattccccgagcatgtctgtagcagagcgtgatgtgattgtgttgtcatttatgggaaataatcgcaggcccatctctcccttcccccccccattttccagtccaaataaccatgaaaaattacacttcaatgtcagcgcgacgacaaaggaggcgcgctctctgggagctcagcggatttgcaggggtttttcctttctttggacaaaaactaccttcaattgtacttcatttaaaacgtgatctaacaaatgcattttgacaagttcctttctctttttctcctttctttcaaacagtattttacacagtttaacctcacaccaaactggaatgttctagaaagaaggggcatgcaaaatagaaggtccttgataccaagaagggtgtcccccatctcgttaaaaacaaaggagtcaagaaaaatgattccaacccagtatgctactgagaaagagaggaggatgagagagaggaaacagtaatgtcttaaagacagaaaatttgataaagccccaccccccccaaaaaaaagctggagttgatagaagaaggtctcgatggagtatttatttgctcatcagaattaaccattttgtggattcagaggcatcatctagggtgtctagatttatggtcagaattgggggttcatgacaatgtgggggggatgaagaaggggagcttccctgatggggtacccgttccctcctgtccccttcctctgtaggaagggacatttttcaacagagcagacctgcctgaaagctttttaacattccaggtgtgaggctgagcagtccctacaagcatctgtctttcaataacaacctgccggaaataaacactgccaggtttccatgctgggaggggagaagacaagacagataaacacacatgagtgatagagagtaaattaaaaaatttaacagtttccattaaagaagactggtatctccttctgaatcaaaactgacttggcttgtcagagagagatcttatgcttaatgcaaaaaaaaaaaatccgtttccttatttatttatttttaattggaaaatactggaaatatatggatgaaaaaaagtcaaggagggcctgtaagtgtacttaagcatctatatacaaatgaaggtgtatgggaaatgaacaggatgtaccagaactgatattaaatgatggtgattagaacctaatgggcataagtgaaaccttgtgggatggctctcgtaacaggagcgtcaacggtgatggatgcaatctatacaagaacgacagccagggaaggagagatggaggggcggccatgcaggcccaaggcatttgcaatgctggggagacacagtttgacaataccaatgggaatgacggactatttggggcaaagagaagcaaaaaagcaaagagaaaaagaaagaggtaaacattttgtgtctgaccatcgaaacaaatggcacacaacagagaaaaataaaaccatgactccagaggtctgagtcacatgaggatacaaatgagggacttggattccctgtttgccaccttactctgaagcccacagcgtctgaagaatctctaacctattcagaaaacagcttcacccttgcgaagcacagaactcaggcagaaatatgagtttactcccaccagtggacagcagaatgaggaactgactgtcaatgagctttgttttgcatgatcataagccactaatatgcacagctggtaaaataagctgattcataaaaacaaagcacaaacaaaaggcttacactttccaaaccaaatctggggaacagaaatcaggccagcttgaggcaatgctgcacccagaaaaacaccagctaaatctgctctcccttggccagacccaagcatatacaaaggtcactacgtatttacaggttgcacattcaagaatgcaatgctagaaacgtgtgaacacccggagtggccaagaaaagacccttacaactgcaagcatcgtggggagccttcaggtgcctaccacgagttccctggtgccagcggagaagagcctaactctgccagaagccagacccaagacatttcaaggtgcgtctacacgtggaaagtcaaaaactgggctactctccaaaaaccatccagtccccaagcatgcatcagtttgaaacaaacaggcaacagaagcaacatgtttcagttgacatttcctgggaaactgcaaagaaagtgaagcaggaagctgaggtacagagaaaatccaaaggtttacgttcaagagctttcctccattaatgggggaaaaagcagatggaattgctaacttgtcatttttaataggcaccttgtacagctattctgtgtccaaggggagaaagaatattggatcctcctcctctttagaaacttagaaagtgatgccagtagttggatccaaagcctctgtttttttaaagtttggatcctgtacaatgaaacggtcttttgctagggtttaacaaaatgccacccccacatccctttcacaatgattttagctacagcagcgctcctcaaatctcccacagctactaaactgccctgtagactcagcctcaggactcgctgtgtatctatttagcttttcctcctgtgaggtgtttctcagacctaagaacaggctagcaacccttgaaaagcaatacattccattccacaaatgtatacagcaatatctctcaaggcccaaaaacacacagtgatagtcatcaagacaaacacttgaacaaaagtaatttaaattctagactcacaccccatcctgtttagtggtgggaatattcgaaaacaacaaatacatgaaacctaagagaaagaaaatgttgccatgagatgacaaagtcatcagggatcgggcagaaggtgcagtttagtgacaaagagttggtacttgacacagaaataagggatctatagaaatttgtagcacacaattacattttaaagaaataatctgggatgctgagatccttccgtgtacacactgcagttggcggaagcactagaaacccgctgacagaaaaatccttacttcagacgtccccaaactttcataagtgagcaacttgtttttttgttttttttttcttttttctttttttgagacaaggtcttgccctgttgcccaggctggagtgcagtggcaccatctcagctcactgcagccttagcctcctcggctcaggcaatcttcccgcctcagcctcccaaagtgttgggattagaagtgtgagccaccatgcccagccagcaacatttcacaaagtgaaatacagaaactggacagtgagagaataaggaaaggaaactcgaaacaaatgaaaggttatgcttcactttgtaaggccaagattttagcaaagaagggtaaaacaagccagaggtgtgaagatgaactaatcaaagggcagtgcaacactgaagataagaccgtcccatgattagaaagaataaagtaagtgattcttcacttaccaagcaaaatcttcaaataggaggaggtcggaggaaggagatttagatggcaaccaatgaaaactttcaaaaaacaaacccaggtaaggttatatcttaaaattaaatatatattatggtaggaaaaaaaccggatcaatttctgttaagaagagctagcctatgagttgactcaactactaaagaactttgctgaaaggttaaaaagaataggaaatgttccaggagaatggaaattaagacagaaaacagccttgaagacaggtaacttgaagaatggagatatataagcaagaaaagataaaagggacattggattaaaaatctacctgtgtaaaatttagctggatacaattaggatggcaaaagcagaaatttcttaggtgttttagaaaatataaaaaggataactaggcagaatagtccaaacacaaagagagcataaacatgaggacagcagatctgggaaggaggaatgaaggctgttcgcaaaagcctggtcaccggcaggttctacctgtgttttgaggtatttgggggagctgaccacaagtacctcaattttacagactaggagaccagggattggagcaggatagggctccaaagccacacagtggggccaggcacagtggctcacacctgtaatctcagcactttgggaggccaaggcaggcagatcatgaggtcaggagatcgagaccatcctggctaacacggtgaaaccccgtctctactaaaaaatacaaaaaattagccgggcgtggtggcgggcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaccctgctccctgggtgctggctctgcgggaatcttccctccatcaaggtggtgatgttgaggcaggtggattctaataatggtaccatagttgttcaaagcaatgcctaatttttctttacagtttaagacaaatggcatggcaaggataaaaaatgaactcaccaaaaccaaagcaaaccccacgatacacaaaacaaaaccagccaatcctgtttccaggcacctggtaccctgttaacttcctgcccagtggcaacatgaagccccaaataaaagcatcacatttaaagaaaggacaagacacagctctctctccccctctcctacatccgcacacactcacccactcactcacatactcctcccctccatgctcttttctggaaaggggggaatcccagaagtactgctcccaaatggcttggggcagagctcatcatcgatattctggatcagggtgaggtccaaggcactgctgacagggttgctgtcacagccccgaatcccagccacagagaactagcaaaagccaagtaattgctttttccccttccactaataagcttttcagcagaggaagaattcagcttcctgtagtcaacagacccttttttccctgcctctcctcgctccaaataatctaaagtgactgcaatttcagtcctggctctccagcattcagctccaatggctgaggtcagagggtgtcaagtgagggctctccatttcttttctactctgccttcacaccgcccatgtttctttgtaactgaggcaacctgcctccctcgcccaaccatcacatgcacccccagcacacagcacacagacctcacattccaggaaatgtattttaaggcccaaaacacactggggctcaggagtggtggtgggggggtgggtgtccctttgctgtaaacaactaataatgactgacctcagatgctctggtgaccagagcagctgatatccccgttcttagaaaatgcaccgcagcaggacattggcttagaggtcgttaaaccatgtggctggttgtgcggtttttggtttagttttatgcaaatgactctggttcctaaattcttaagatcttgctatgcatttgtggcattggtatcttcaggcctggctctgtgtcgaatgagaggcaagtagactgccccgaaaaccctgccccgccccctccccttcctcatttccgagatgaatgaaatgctatttcaattaagtcctgtagtaacagtgctccccttccctgccttcatagagagctaagccgagagcacagacagaactgaaggtgaacaaacaaagggaaatggaatgaatgagagaatgaacaggtgcatgaggggaacgagggaggccccggcaggttcctgctcctccgtgtggcggaaaagagggcaaggtgcggacaccagaggcttgcttctggaaaagcagctccaagcgggggaaacagaggcagcactgcggagatgaggcacacttcttcctccccctgcgcccagtgcttgtgaaggtctggaagggaaggaaagaaggggagatgcacctgagaaaacactggaaccccctccccctgccaccacacacacgcctagaggacgcacactcctggctgcagcccggcctgtgatgggaatttatttccctcaattatgtgctcttgtccccagtctcagttcatcagcacagtgcagccaagtcaatgaaaggctccataatgaagtcatcgcatgcacagggacatcccggcacctgcccgctgggctggcagggctgcagccacgcccggccctgaaccaggcctgcgtgggctctccgcccccaactcacatcactgccccacgccacgtgctcccacgctctgtgtcacggcacccccgtcctgccccaggagcctgtgttctggctgccatcttctttgccccaatcccaaatgttctgaccgcaaagcatctgtgacccagaccaatcagtacaaaacactgacgactttccctttctcctgcctgtgtagaccccttcaccaccaagagcctgatcacaaaaaccaataccacgcgcctggaaagcctccattggcttaagtcattagcaagtatctaacaatagcaacacaatcatcactcagctgaagtagatagtattaggactctcatttcacagatgaggctcagagaggttaaattactggtgaaggtcacatagctaggaggtgacagctgatgccaaggaccatatgcttaatggctacctctagaggcaccaaccatggtggccttcacaggagaacacacacttgtgcttgtgctgtctgtccatccatccgcccacccatcacatatccatgtggcacctaccccaggcattgacaacacggctgtgaacacaacaggaaagcccctgctctcatggggcaggggcaggaaggagtggggagagtaaaacacagtaagcagctcagtaagtgagcatattctaagtcagaggctgctaagggtcaacgataaagtagaaaaaggaatccagggagttccttaacatgggaagctcagagagggtggcatttgcacacagacctggaagaagtgagagtgtgagccacaggaggctcacatggcagaggcatggcacgtgcaaagacccagggcacagaaggagggctggcctgctggaagagcgctgagcgctaagcagggagagaagggacaaggcaggggataagctcagagaggtcttgggcagcatcctgtaggccttgctacccactgcaggccacgggcactgtgagcatgaaaggtacctttgagaaagtcagaacaaggtgctcctccagcacctcttcctctgggcacatatggtcctgagacccaccactccctctgctgggtaaggtagtgtctgggatggactgcagtctttatgcatcccccttagcagagaactgtttgtgtgggggacaacctgcacggctttagctggtggccccggcagggatttccagtagaaaaactcctgtctttccctaaacatgcatgtgcaatatatcagtgcagatacggatgtggctgcagatacagataaaatctctttgaacctttccatttactgggggctggcaggggtgggggtagagctggcctcacggtgaagaaacacaaagaggggaagcggaccagtggctatcctttgccatgggcggtgctgcagcacttggacagtctggacgcccataaaccaaaggacccatctgaccatcgtgctctgaagcctctccctgagaagaggacagggcagcaccaagactggggtgaaggactcaaggctcagaatggcaaatgcagaaattagttactgcggtgcaaatgcagaaattagttactgactgttctgcatgtcccttctatggaaatgcattgtccctgcacctaaatgtatttcagtggactttgtaaatttaaaagccatagaaaactatgtgacctcggcagggctattttaagctagcacttcctagtacaaaatgaatttggtattgaggatgaaggggggactttatttttctcaaattggctgttgtagaagaaagtctgctcaactcagcactacctaagacgtgtctccccctagtgacacgcagacctctctgctactggtgccaccaccctgcagtctcagggctggagcaaggcagctaggtgcaggcaggcagcattagttctgcaggctgcatctggccctgaacctaggaccagccatctcttggtaccctgggagctccaagaaactcagtggtcaggccccggagtgttccaggttttgctgcaatgttaagaagtgagcccggagcacccccagggcagctgatccacacacagcttccgcagccaagggaaaagaggggatggatggaggccaggataaagaaggggaggggtggcaggtaaagggaatctccccagaggagtgaattcctttccaggcttgctggggacccaacagggacaccccaaaaggcaaggcctaaagccagagcaaaaacaagcagacgcaaagcaggggagagtaagcgatgggcgaagacataaaagcccaaagatgagagctgaatggaacaggaagcaaaccagggccaaacccatcacggcttaaagcaaacgttaatgtaggttccacattgatctgaagcccgagggggaggaggctgggtgcagccaggctcctcccctcctccatctcattccattcacatcatcaggagaactgtgttttggggaaggggtcaggacaatgattggagcctgaacttagctgctgccttttacagtagcttcccagaataaactgccccaagacttcatccatcaccaaaaaaggcaactgtaaaaacacaggtcgccagccccttgcctcacaccagcacagtggccctccctccgctcctggggatgggggtgctgagggggaatggagggcaggcgctcaggcctggcactaattgctcttggggatgctgtgtggtgtgggggctgttccctgcgctaagcagttaggaacttcctaaatcattaacctttctcggagcgcattgtactgggaggtgctccctctgcagcctattcacgagccctattgatctgccgcacactcggtgccttcaaagttgtttatgatcaatatgcaaattgcccatggcattgatctagtattaattttcaattagggaatccacaaggggtctctgagggtcaatacctaacaatgcaaaggaaactccgctgtggagtatcaggcctgatgctgataaaagcttcctaagcctcctcctcaacagttccaggccctctgggctgtcaccttcactgtggctcatttggttccctcctaagtcagaccccttcggcggcctcccaggctgggtctgcggccatcaccctgtgccccccctcccaccccctatgccactggaacacctcctggcctgccagtgcctgcccctcttgcccgccctcctgatcagatgcccccagacatgcctcctcatctccccatgccacgcccagacccaggaccactctctcccccagctccccaaccacacataccttcttcctccctctttccctttccctcgtttctgcttagtcacggaacgtcaccttggcatgctgccacggctggagctggcgagctgcacggtccccagaaatctcaggcaggcaggcagagcgccgggctgccaggttatgcttggcaaacaacccactgatgtcatttcaaaaaaccaggggggaaggaaaaaggcacagcttcaaatcatctgtttctccttctttctttcgtctagcaaaatttttcttcctaatgaagcccgggggtgggggatgttaattactttaccactcactcatggttcccagaagaggccaacgcccgccctccaggagcacagggcagtgcgtgtgagccactgacggagagtgtccctggggacagtgtgcccagctgggactggaatgacccgggaactcagtcattccatttacgcccctaacagcccctgagagacttgcgtgggaaagctctgcagccagaggagctgcaagagaaaaacgtggcttggtctcctcccagcaggtagggggacaaaagcagggctcagccatactccagcctggggcccagccggctcagcctgacttctctctctgccaggaggttgaaatgtgcttacgtttggaataaacctgcctgaagatgaggccacgatcctgccaagatggtgcccacgatcctgcctaagtcccaacccatgccctgcccactttccacactgccactcatggcactaaccagtgcattagctagccaggctaataggtttatggataacattaattaccacgttcctcattaatggatgaaatctttattggtgccattgatcagcggacttgttagctggcctcctaaccaatggcggatgtaacaagcgttcttattggcatatcaattaatgcaatcaattcctggccaacggctgccattcacttccctggttgttcgagagtaggagacagagccctgtcaagagtgcctttacttagagctccagctctcagctgacttccaggtgggctctctgccacttggagttcacctaccaaaaaaaaaaaaaaaaaaaaaaaaaaaaaaaaaaaaaaaaaaaaaaattcacacctacccttccatctgaaaatcacctttccgtgttccagtgatgacaaaagtgctaagctacgtcaggggacataagctgaaagaaaaggtgggaacggtcgggggactgtcagagcaaacaagaggattagagaaatcagatgtttctaggttaggcactgatagaaatgattcaggccccagactggactagggacaacactccagatgggaccagcctgaaaacacaagccacagccatcatcagccctctgcccaccctggggaagccttcctgaccccagcctccccaagccacagtcacacctactgtcacacctacaaagtcacacccaccagtgtctacctcacttagcacttcagaccacaggtcccacatggaaacatcacctgcccatcttcactcctacgcttcagtacggaaaaggacttaccacaggacgaacgaccatcccactgtcactaccaagtgtgcagtaaatctgtgcacacaagtgctattttcatgtgtgttgaaatacacatagtcaatcatttcaacagcacttatatcactgtagagtcgaagttggggaaaaaatttctctgggcagcgagaagtttttagggacattgattagaggaggctcaaggaactggggatatagggtgggtccacagaaccatggaccatggtagagctggactactgatgaccagtgatcaccagggcattaacaccagagcaaagaggccgggctcgccaggcccacagctttgggaggaaacgtggaggatgcctccccctaagatgtgctttgggctcaaaggattgactggagtttgccccagatgggagcagcttgaaatattattccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggttggggggagaaagtagctttgggccaagtggtgacagggcccaggagcctgactgaggctgcggtgcagggacataattctcagcgtctgaaagcatggctcggggtttctaggataaacagcagaaatatttcctttcacttataaatagaaagtgccatttttttccacatggaacgtcatcacttccatgttcacagtacggaggagaggagagtcctgagcagacagggcagggaccagagagagatgccccagccagatgttacactctcagggtggggaccaacagataccaggaagaagagggacaagaggcctccaaggggaggccaagacctctgcaatccacgaagtgactttacatgaaacaggattgcacattctatgcaaaggtcacccaatgtgggtgacagggagataccccgacaaggggctcttcatcagccactcaacaccacggcgagtcttccagagagagtactcttgggttcttgcaacggcaaaagtcccagtgtacttctgactagagttcctacagtattaatataatggtgtctaaattcctctctggggagctcccaaataccacaagggttctgcacattttgattccaatttcacttttttttttttaagatggagtctcactctgtcgcccaggctggactgcagtggtgcaagctctgctcactgcaacctccgcctcccgggttcaagagattctcctgcctcagcctcccgagtagctgggattacaggcccctaccaccacggctaatttttgtatttttaatagagacggggtttcaccatgttggccaggctggtctcaaactcctgaccccaagtgatctgcccaccccagcctcccaaagtgctgagattacaggtgtgagccaccgcacctggcctcaatttcatttaaaatgctgtaataataaggcatgctcaaatgtgatatatgccaaaatttaacacactggcggccaggtgaactagttacgtggccaagttaaacagcttttgcgtagactttagcataaaacttctgccattttcacttaatggaagactcttctgggattgcaaggcaggctattaaaaccagtcctgtttggaactacttctgtatgaaagaggattatacagaaattgtctaaaacaaaatatagaaacaaaacagaagcttagttgatactatttaactaccttccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttcctttttttaaaaaaagagggagaggggctacttctgttctctgtaatgttgaatgctcaagagtggcagttgataacctaaccagacagaacgctccccatggtagttttctcctccaaagaaaagagcttagaagctttctctttggaacagaagagtcctctattcctttatttgctcactaagtcattagttaaactatccgttcatgcctcctaggtttcagccattctggatccaactggacaagtgagtcacaagcctgccctcatggaacttaccctccagtagatccactttaggtaacataagatggctgtgttatgtccagagctttctcattgaaccatcacgtcaacatgtacttggacaagaaaatcacctctttgactctgtttgctcacctgagggatgacaaggttgaccctgggtggtctaacagggccaccatgctaaggctctaagttggacaccttcaatactatgaatagcaggaattgttaaagaattaaaccccacccactctaaaaagactgtctgatccaggcttccctgaatcttcacctgggtgattatgatcaaggttcttctaccaccaaacacaataagaaatcaaatcttatcagaattgagctataaatctgtgaagactccaataatttctagccaagggaataacaccacaaaagtactttttaaactaattactcagattctgaagtgctgccctaatgagccttctttctgcccagaacttactaagaggaaaaactaccttctggtgcagtaattactgctttccccttcaaacttctaactggagatcgatgctgcattttaagacccattgatttacaattagcctggctttcctgctaaagtgttttttaagcagagtttacttttattttattttgaaatctctgagatctggttcttggattttacattctcatgagaggagactggaaatctcaaaagaggaaggtaggcattggaagagagggcagtagaaggatgcaaatcagattcaggagggcggggaaggaagaaaaggaagttggtttggtcacagaattttttttttaaaagccaaaactcatgctgaaagggagagaatgaagaaatccaaagagaggaagcagaaggctgagcggcaggaggagagagctaggtgcacagactaataaagtgtagctgctgtcaaggtggctggaatagctctttatggcctccgctgtttattagcatccttgagaaggaaaaaaaaaaaagaaaagaaaagaaaagaaaaagctttgtgcatctttgcaaaacaaagcactagttaaaaatagtgtatgcagcagggacagtgtgctaacatgagggtcctggcagctccagcatttgcacaatctgtcccatgaggagagcagaagtaagcgaagcaattaagaatttcatgctgattgctctaagcatgttttctatgccataaagatactagcataaaggatatggccttgcttctctccctcccctgcctgctaacttttgccttctagcttttggacttttccttttctttgcctcccatgtttgaggattcgagacagtggttagccggcctggcaccactttatggaatctgtcacttctataccgaaagaaatggcggttgtgtgcgagtctctccctgcccttgatcaagagcaaatctggaagaggagatataagccaagctgcattactaaagccctaaagagggaaggcttaaagaatggggaaactccctctgaggcctacaaatccgggctctccaaggcccctcctgccactcccattctggctcttcactatttctgggtcccaagaacgactggcagaagatggtcctggacaaatgagagcaaaaagtaaaaattcccaaacaataaggggggagggacaaaccacaaactttttgcttttttaaaaaatgtattttatagcaagattggataggccaatttcaaagactaatatgaaaaaagtgcaattaaatccttgaaaaactgacagatcagcaaaacaaaaccacccggaggagagcccgattgagcctcattaagagggagttcagcctgtttttaaaacccttcttaacacttagctgggtacctcccagcagtgcgcactcccaatgcggctggcataattagtgtcaaaatggaaagaaaaaaaaaatcaacctaggaaatagaaattaaaacacaaattggtgggtggggggggggtgtcaaatggaaaaaacattccaaattcaaacaacaaactcctatcagtccatctgagggcaatggggagatagcaaaatactctactgtacgcagagataaatacgttccaattaaacagagagagggctggggcagattgagaagatttatgctgcaattccccatcttcaacctctccctcttctcccaaaatatattctacattgtggtcacgtcaactccacaaggctggggttaatggcagatggatggcaaattgcaccaacctcatcaattataaccatcatgcctgacaatggggaaaatgagatctggtgacaaatttccacaccttcagccatcaggatcccccaacgctggagcgcgtgcacgcgtgtgaaacagtgtgtgtgtgagagcatgagtgaatgcattacatatgaaaccaccagcctgtaataaggagatatggagctgagacccattatagaagggcaggccactaaggaagaaatactctggagatggaaaagatggcaggcagatgaagccattttattaaatcaggcaaattctaattcattctgcagagacagaggaacgaaaacggattcattctcagtatatcctctgagccagctcttatcacctcagcagagggaggagtgaaagaaaggttccaagattcatctggaaatcgagagaaaccttcccctttaaaaagcaaacattaaaatatatctatttcaataccctgcaccaggaatatggaaaataatgctcgcgccagagaaacgcaggggtccttctctggctttccaattattccagcacgtgaagaagcttacaaatttgactcattgcaataggaaatcagaaaggcaactgcagcctagataagttgttgacaaggactgacaaaagggattgtggaacatctcccccaatggcaagaaacgccaactgccaccttccccgtggtgggaacttaaatgtcgattttctagttgaaaacagtggaaaagaaaggccgtgtatgagaacaccaagcacagaggttgcctttcattaacaaaaggcgcttgtgtttagactgcaattagaaaaccaaggttttaattaaacaattacataaaagttagtttggctccctgtatagtccaacacttcaccagcgccttggggttagtttagcaatgagtgtttagagctctggctgctatgaaggggggaaagaaactgatgacacagcgtgcatgtaactgtaaagctaggcgctgtacctgtctgtctgcagctcccctgccatgttctagaacaaaggaaaagccaatgagactgacaatgagcacgcacgtggtcagaccacaagccatcagtaacatcgtactactcatggctgaacagaagagattattcaaagtgtcatgcaagacctggggggctcacgaggcttccggtgttcccaagtgaagagctgcgtctctatcaaagcacaggccaggtgcagctagcttactctgtgcctcttttaactaagagggatacgcaggagcttagatgccttcaaaatcccaaaccacctctgggaggagaagaaagcaatctactttttcacctgctgcttttacaccacctggagacagctgcccagggcagacagaggtacgtgtaggtccaagggcttagattcctaggggagacttcaatgtctaatcttcctagcacatggaaaactcctctgtggctcccagcaatcatcaacctcaatgctcaagagctgcaaaatgaagtgaaattagttcttccctatacacatcagctttgaagacagaaggtggccaccttctactaaaccatgttgcaggaacagcctgggccatctccacccttggtgaaatggattgtgtcaagtgagtggggcctggcttataaatacagacaggaagattgatcagttttcactccacagcacccaccaaaagtacacagacctcaaaaagcaaggccattctgccagtagggcagccagtaaggagaactccacactgacacccgcaggtgatgcttcagatcacacctccacaggagctaaatgcagccttatgtttccacaattccacattcccctgccttcccacctgcttggaattcttccagctctgaaaagacccatgtcaaatgataaagaatccaagatgggcagccagttgatactgaccaatggcctcatacattgcctagcactggactatcttcctaggcatttctgatcaagtcactgaaagaaaacctaaacaacagagctaattggttggcaagatgctgtattctgtataatacccaaggctaaccaaatcacaaggtaatcagtatttgttagttttcatagaggaccagccccatttgggtttcacaaggacaggaagttcctccacctacagagataacagaaaaataaaaaataaagactaagctgagtgtggtggctcatgcctataatcccagccctttgggaggctgaggcaggaggatcacttgagcccaggagtttgcccagcctgtgcaacatagcgagacttcatctctacaaaaaataaaagtattagccaggtatggtggcacatgtctgtagtcccagctactatgaaggctgagatgggaggatagcttgagcctaggagtatgaggctgtagtgaaccgcgatcgtgccactgcactccagcctgggtgacagagcaagatcctgtctctgtaattgacaaaaacaaaacaaaacaaaacactaacaaaacaaacttaattccaagttaacaaaagctgaggagttattttttcccaacttcaggctgcagccctgctaggtttgcaaagaaatgggaaatttaaggataactctgaaggttgtataattcatgccactggttctaaaaagcaaagttgccttccccaccaaaatccttcatctttcagacaaaggcagggttttcttgccgtttccaacacctgacagtgtgaactaccggagtaagagagcaaggaccagggcccgctgctcctcagcctgaaaggcggggcagccaatcagaactaatctctgtgctggaagtaaattcagtgttctcttccctgatctggtgcggcggggggctctgacggcaggggtgggcttgcttcccttggtgcccccatcccataccctaaaaactaacaagggcctttctggtcaacacctctcaccacaagcagccgtggaagaaattattttagatcaagcccaaaatgaaatccaaagcaacgaggctgactttatgacttatttatttatttcttccttcacgaacagaaggttaatataagagcaactccttggcaaacctttaagggtaattcaagcgacactgatgtgaatcaatgttccctttgtgaacacattacttggcagaaactggctttttgtaacccccttaaacatagccggcaaaacaaaaagaggggggaaaatgtccttcaaacaaaaggatgaggtgaaaataaagagagagtcgactgcactttattctctttcatagaagcaaatggatctggtgcttttatacattaatcaatcaatatcactggctgtacatcagcagggtagccaagttatgaatgacctttctggcaaagaggacacttttaatgctcataagactgctcatagcttagcaactttccgaatttatgcctgcatgattaccccttggaggcgagcagccgtgagtgctgcactaaatatggcaaggttagtcgttttcaatttgtgcagagggaggaagagatgtggacctggctgccccatttacgcacgagctgccgcaacctgggcgacacagagggcagagccccaggccctgcagcgggtcagggctggcctcccttctggaaagccggccgggtctcctgctcagcttcaggccaaaccaaacacggcagcttcagacagctcatctagaaagctgtgcccagctcaacttcgctttctgtctgcttctcacaatcagatcctgagttcctcaagctgacagccaggccggactggccagcacggggtattcccaggctccctccacaccctctgccctctggcttctgtgcctctgaaagccctccccacgttgattggactcctccaaccaggtcacagcttgatgtttccaaaaagcaatgagaactttcatctttgttttttctttttttaaagcaatccacagaagggcatttctaccgaaaagatgacgctctccagaaacaggcagcccacataaacaaactgttgggccaatcctctttcttttcccctgtcaccaactcagccattctcttcatgtccaaaaggcgagaaagttctctggattccattctttgtgggtggaaatggggcaaagggttgcctgtgggtctggatttctatgacaaccgctatcgtcccagagaggccgcaagggggcaagagacaaaatcccacctcagccttcttctcccaactcctcttttacagccatgtttaaagtctctggaagtctggaagagattcccaacttggacatgtggaagtccacttataaggccccacttttttctgtctcccatagagggaaataaagacgtttagggatttgaaatatagctttaacttcatataaattagaacagaagaaaccacaggctaaaactcattggccccactggagtacaaggaaaattcagcgcagaaacgagctttactgagaccatcctttagtctacaaggagttgcccagtgaggggagaatgcggcaggacatgggttagaggaaatgaacagctgggttgtggtcacttctggtaatggccttaagaacacaattgggccactccgtgttcatatttctgagatcagaagagtttacagaaacaggactccgctccaaggtatcactgatagaagcccccaggccgtaagacaggctagtttacagaaatggaagataaataacaatgaaaacaaggagaagagaagcttgtaaggacactatgcaggcatctccgaaggggtggcgagttcttatttccgtgcccctcgacatggtggacgtttgcagctcctagcccagctgggaagtacaacactccctcagcgttccacatacttaaataaataatcctggtctcgttaccgattatattttaacagatccagattcccatctagaaaaacggctttctgtttagagcagggaggaaaacacagagccccctccagctggtccccctgcagagctggttctgggatggtgccgcagacacccgcttcctgttccatcaggcctcggtggaacggctctgttttcccccaggaagctccaaatccacaaagtcaacaattcttaaaagcctgcccgctttcccccctctttcctttcagcgtttaacaaatatcaaacgtgtgtccctccaaaccaccttccaaatttacaaactttttactttttgagacagagtctcactcactctgttgcccaggctggaatgcagtggcacgatctcagctcactgcaacctctccctcctgggttcaagtgattctcctgcctcagcctcccgaggagctgggactacaggcatgcaccaccacgcctggctaattttctatttttagtagagatagggtttcaccatgttggtcaggctggtcttgaactcctgaccttaagtgatccacccgtctcagcttcctaaagtgctgggattacaggtgtcagctaccacgcccagccaaaatttacaaacttttaggtcccctttggagctgccaccctatggaccgccctcacagaacacaacacctcagggaaggggttggctaaatgctcagtcgtctgtcctttctcgatctttgcgcaagcctggctgttcctctgacagctctcaaaaattcatccctggtctgacagttaaaaataatgcatttattttttgtgtgcacaacggtgactttacagcctcccagggttttcccaagttacagacaccacttgccaccacttttcttcatcttctcttacctggccaacagcaacgggtcagcagatgcttttctcacgcaccttccctctcccatgcaaatgactccctaacccgccatccacctggcagacacctgtgtcccctgtgctgtgttgacatcacccttctggaagtgcttggtaccaactgtcccctacagccactgggctgtcttgtcacacattgccatatggcatgtcctcgttttgcatatttaaatcgctatatcaagaatattaacaaagataaaagggtatgagatcttcccactaagcatcgggtggaaattctcacattagtaataatgcaatgtgaacccaacccccaggatggagaagccactcagaagctggccggccatcctgttttgggtgcagtcccagacacaaggacaagccctccctgggaggcgggttactcctcagagtctggaaaaagagactgtttccccatccacgtgcacatttcattacaccagtgaatcctgatacctgggtaatttcaagcttttaccagagcaagagaacaccctaatacccccaaggaagccccaaacgcctcctggaaaaccagagtccaggaatggaaaaatacatcagagaaaaattctatctgaaaatgtggaattaccaacatgcaaaagatgccagaaccagaaagcctaacctgaaggtccacatattttgtaaaatttgcacaagaatagatagaacccgctgggcatggtggctcatgcctgtaatcccagcactttgggaggcagaggcgggcgggtcacttaaggtcaggagttcaagaccagtctggccaacaaggtgaaatcccacctctactaaaaatacaaaaattagccgggtgtggtggcatgagcttgtaatcccaactactagggaggctgaggcacgagaattgcttgaacccgggaggcagaggctgcaatgagtcaagatcatgccactgcactctagcctgggcaacagagcaggactccatctcaaaataaaaagaatagatagaactggaattttctgtttcattgtcggtgtcctctgctccctgagaccatatgctctgtggggaggaactgtgtgacacactgtataccatgcaacttcaagggaaatcaatcatgttaggccactgctgaatacctccaagggtttcccatagcactgaaaccccaaacttaggaccctgcttacaaaggtgggtctggtggtagatgccacccacctcagccctccctaggacaccaattgcactggcctaccttctgccccagggcctttgcaccaaccaggccctaagcctgctgtgttccctgccttcttcaaggtcaagtcaggtcacagcctaaatgttaccaccttaaagatttagcatttaacctgcctttgcagtattcagggtaaacaaatatttaatgaggaaagctttcccttgataaggagtagcccagctaataagtgaagaaataatagaatgagaatatcatcattttgccagctccaaataaataggagatttgggcaatgatcatcaatggctaataacatcacaaaacaatcagtgagacatgtatctcctgatcagatacactgactaacacacatgaagcagccatggagaaaaagtaaaactgctcctaaatgagatcaagtgtctagatttaactatcagttcacagaaaacacaggggtacagaagaacatgttcaacaatgctgtggggctataatcatcaaaacatccaaatcccgactgcagggatcctacaagatacatgattcagtttcttcaaccaaaattgcaaggaaggaaaaaaaaaagttagaagaggaacatacaggtaaagagactttagagacatatcaattcatgtaatgtgaacaccatgttggcatctggatttaaacaaagcaactatcaaaaaacacatgtattaggctgggtatgacagctcacacctgtaattccagcactttgggaggccaaggtggaggatcgcttgagcccaggagtttgagaccagcctgggcaacaaagcaagaacctgcctctacaaaaatgaaaattaaaataaataaaaataatccatgtattagggaatttttaatatgaactcaatatttgatgattccatgaatttataatttttaggggtctgatattgcagtcttgttaataaaaaaagagagatacaggtcaggcatggtggctcacacctgtaatcccagtgctttgggaggtcggagtgggaggattgcttgagctcaggaattcaagaccaacttggacaacacggcaaaatctcatctctactaaaaaaaaaaaaaaaaaaaaaaaaaaatttagccaggcatgatggtgcgtgcctgtagtcccagctactcaggagactgaggcaggaggatggcttgagcctggaagatcaaggctgtaaagagctatgatcgcgctactgcactccaacttgggtgacagagacagagagagagagagacagagacagagacagacagagagagagagagagaaagaaatagggatgaaatgatataaccaagatttgtttgaaaataattgagtaaacggaagcagggagtgaggggtagtgtatagatgaaacaggactggctgtgagtgggtatctgccgaggatggatgatgggttcatggggtctgctggttcatactctacttgtggatatgtttgaaattatccaactcaggaacacagatgatgggttcatggggtctgctggttcatgctctacttgtggatatgtttgaaattatccaactcaggaacacagaaggttcatttttttaaaaaagttccttccttctgcactttgggaggccgaggtgggtggatcatgaggtcacgagatcgagaccatcctggctaacatggtgaaaccccgtctctactaaaaatacaaaaaaattagctgggcgtggtggtgggtgcctgtagtcccagctacttgggaggctgaggcaggagaatggcgtgaacccgggaggcagagcttgcagtgagccgagacagtgccacttgcagtccggcctgggcgaaagagcaagactccatctcgaaaaaaaaaaatttccttccctgactatccctctacaacaggtacctcaacaacccctagtcacccatcttatgtttgattttaattctttacctgacccttatatttttttcttttgatttactcctcataaacccttcttgatgtaagctgcacaagagctggggcctggccacccacattgaccaccatgtctctagggctttgaagatacctggcacatgggaagcttcattaaatacacattagaaaacatagaagcacatgtacaaacaagaccacatcaatcattcagtagcaactcagagcgtcgtgctctcttgtctttgtaggaagtcttgagggggcgttcatcccccttcttaggaagatgtgaaagtattcccgggccacccaaacagtttaagcattgtatcttggcaacagactgtcatgtatcgatagacacacaagtaaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagctatggcctatatcagaatccaaccaagaatgaaagccatcaatcatctacatagcaggctatttggaaacatccagatgttagagttttgaagatgatgcctagcgcaatctaatggaagtgttgttcaatttatgagccgtgatgatgccacctgaaaaatgagactgtcctgtaatcctggaggatgcaaataaagatgtgggccagtgcatttccagccaggatagcccaaatgggtgttaggtgaggccaatattcctctaccaatgaggctattttaaaaagtggattttgcattcctgcctactgtcaggatagtgacagccggctgaaccaccctaatgaattattttaaacagaagatgaaacattaacttaggaacctgagagagaggctttcactttcttaagatgaacctgtgacttgaaagagtctcaccaacaagtatttatggatgacttccatgtgcccaggcagggcacaagactgaggactcagttgagaaccaggtaaggtcagaaagggaagagaccaatgggaaaagggcttgtggctgagatccctccaaggtgccatccactagcccagcagaaccctcaatatacacacaagcccgttcagccccgagttgggctctgagtgccatggatctgtcttcaccttcatggcggccctgtgctgggccatatcaggcatttgggctgtgacagcccttgttaacagtagtgcttggctcgctctctggtgagctcccagaatgaacttggatcttgtccccacccaatgtgccaacccaagggcacactgacaaggagtatgctgtcataggctatagggacaggtataggcaacagaaagagaaggcgagtttttgctactgagatggagggtacctccactacctgtgactggccaaagaggaaggctgtgggttggaggtggtcagggtcacctccaaactcatcacaaatgagggcttccaccatcaggactggctcttcccaattctgctgctgaccaaggcttctgtatccacagagaagccctctgtggggctgtgtgccctgcaggctgaggtcatggttacgccactcatgctcctttgaggcatgaactctggagtagggctccccttgccctacacaatggaggaaacgccatgctgaagattccacatgccaccgggacagccctaagtgggaaagggagacccggggcttctctgagctcaacatactcctcccacacaaaggaagcgggtgtactgaggctgcagcccagaaagataatgtgatgcggtcgtgagatgcccaaattggaaggaggaaaaaaaggaacaaagaaatcactgtggacagatgaaatgaaaatctggcagggctctgtcctaacaaatgatcctaaaatgaaataacactaacttttctcctttggcagatacacagagagggagagtgagagcagtagccagagagggagggtcagaaagaaggttgcacccactatgtgccaggctccacactaagtataatgacactttatgtacattccctcacttaactgtcaaacaaagattaatgaggtagaccccctgagggtgcatttgcgtccccttttataggtaaaagaattgaggctcaagaagggtgcaattgggagcccctgaaacaaacatgtagacatttttttgtgcatgtgcattcatgagcattcttctggggtgagggatcatttctttcattagattacctgaaaaggtaagaaatcctcaggttatataacttgaccaaggtcactaagctcagaaaagctgggatctaaactcctatgtgacttataaaagcttctgcaaccagatctgatctgaaagcccccagtcttcactgagtaagaaagaaaaagaaatacaagagttgaggagatggaaaaggaaatgagatgggtgctgggtctaagtagaatgtccaaggacatttacaagcccctttcactatcccagaggttcttcaaagccatggcacctctttgaacatcttcagtgtacagaagtgacatgaaccaaccccacaacaaccccacccattcaccatccacacaggcacaaacccaccgacctgcagttccaccttaactgaagccagagaatgacctggaaacaatgggataagcaggaaatatccagattccctaaattatcatctctctggaagttctgcaaaatatgaacagtcattatcttgcctgtattgcttttcttaatttggagagggaactgtgtagaaagtaattaagagtgcacctcattggcatgaatgtttcccaccatgggctgaacagaagatgatgtggtgggtccagtgtcaagtctcactaagccagcatgagactgtccaggcggcatcctcaaccccacaggaagctgaggaagctgtcatctgtgactctgctgggaagaagctcagcattaattctactccaccaggtgtcaataatgtcagtgtggcatattatgtgattactctgagtggttacacaaaatttagaagaaaaaactgcactaacagcatcactcgcagagcagaactctggaaacgtgcactttacgcaatggagaagtgcactctgtctaatcctgagcaggaagatgagaacgattttataagtgtgtccccttctatctggaagattgcaagacacatggaacgcctttcagaagacaaaacataccaaaacataccaaaatctaagactgtaagaagcaacatcgtaatcccatgctaacgttaataccctcatggagtacgactacccatgagcaaactcttcttccatttattgttgacaccagtttaaacatgtaatccacatttattttgattggatcatctatttttgctcttgcagtcatttcctgtcaagtttctagccaaggtgaaaagtagcgaacccccagagtagactctttgacaggggaaaaaaaaaaaaagaagaagaagaagggatgctgtctgtgcccaggcactattttcttaaggtggcagctttcctcttctaatgatgcctctggtcactgcaccaaccagttgagtcggtttttctggaaagttctcaccaatcactgaaaagggtgtttgtggaggccaaaaatggtgacaatatcaagagccgcacagagtctgccaaggaacccacggggctccgacaagatggcgcccaaggaagcatggaactaactgagccactgacgaatgggatagattctggacaaaagtaatgtaagacatgatccctgccccaagatgtttccaattttagggatgaatagtaagcaaatactaagtaatcagccaaacgaggctgtccaatctttttggaataacatgagatacataagtaatacataaatgtaattgggtgcaagggtcagtggtacagattcactgctatattcatttacaaaagtggggaatgagggaggtatgtgtggttttgatgataacatcattttcaccctcccttcttacccattcctgcccttcatcttattctctcccacttggagaatcagcgcctatccaaggcccaagctcacatcctcagatcatccttacctgctctcttccccatttctcccaggtggaaccacctaaaaacagcattaagtgtctcactctaacctagaccctctggcatcctgcaccttacataagctttccctcacattcttccatcttccactggggagccagtcttaccctctaaaacaaggagagatcaggtgactttgccaggtcccccagatctcagggctccgcactccctagaggggaaagtccttgcttctccccctccacccgttcgcgctctatctttggctacaactacatcccatgacctttatacactggcagatcttcagttttcagggtccacatcgacaggcttcttaggaatcttctcctgttagacagtgagattcctcaggcacagagagcctcctggtcaccttctgcacctccaccttgattgcttctccaggctcaaggctcagtagccctctgttcacctcaggagttgtaagaaacaaccctattgtacatacagccttggagatgaaagcaggaataattacctccagaaaggaagagtgggtcttggcaggaattctaagaatggacaggagaaaaagctgacgatgatttgacatgaaaggaagaaaaatcagaaggctgtatttccaaaatccaaataacagagaaagggtgaaaggtgaagatgagactatgctttctgagccatcccagggcaaacatctgctttctcattcatttccttcagataagggagagaagacggaaaggaaggcaggaaggacttcaaatttttaacagttttagtagagaaaatggaaaattaatcaaatgctattaccaggccttacatttaaaaaatactggggagactagaaacacgaaacagcaagcctggccctggagccttcactttcccttctgtgagctcttgcacagttaccagcccctctgccatcatccttcaaggaccagccagccagagccctcgccaaccagaggctcagttatagcagaacacactgatgagagctaaaggtgttttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttctaaagttctggcctgctgaatttcctgatcatctagaaaaccgggaaggggagtataggctaaaaataaaccttaatgaccaccactttcatttgccaaatatttctccctattgatttttattagccattttttcaaaacaatctcatttaaacagttcaattccttattaaatcatctccaagcatatcctcactagattctcattaattacaaagggaaaaatagtaacttcagaatggataaccccagaaggaaccaccataactaactgaccaaagctgatgcccgcaatcaagagacaaatcaatatcatgtatctcatgaaacaatacacgagaaagaacacgctttcttttttggcatttctaccaaaatacacagcctgattctaatcataaggaagcatcacatgaacccagttgaaggatacttgacaaaacagctgacctacactcttcaaatatgtcaaggtcataaaagggcaagacagaggaacaatgctagattaaagaatatgggccaggtgagatgtaatcccagcactttgggaggccaaagcgggcagattgcttgagcccaggagttcaaggccagcctgggcaatgtggtgagacatcatctctacaaaaaatacaaaaactagccagatgtggtgatgcatgcctgtagtcccaggtactcaggaggctgaggtgggaggatcacttgagcccaggaggtggaggttgcagtgagccaagatctcgccattgcactccagcctgggtgacagagctacagagctagaccctgtctttaaaaaaaaagaaaaaagaaaaaaaaacggctgggcacggtggctcacgcctgtaatcccagcactttgggaggcagaggcagacagatcacggggtcaggagatcgagaccatcctggctaacacagtaaaaccctgcctctactaaaaatacaaaaaattagccgggagtggtggcagtggtggcaggcgcccttagtcccagctacttgggaggctgaggcaggagaatggcatgaacccaggaggcggagcttgcagtgagccgagatcgcaccactgcactccagcctgggcgacagagcaagactctgtctcaaaaaaaaaaaaaaaaaaagaaagaacatgaaagaggacagctaaatataccttgtgatctaagatattcttttcatacaaaggatattattaggaaaatttgaataaggactataataacctaatagttttatagcaatgttagttctctgattttgatcattgttctgtggttatgtaaaatatctttgttcttaggaaatacacactaacttattttgatgtcaaggggcaccatgtgtgaaatttactctgaaatccttcccaaaaaaatggcaatgtgtatatttctatttattctccgtctttatggagagagtaagattatgaatgcgagagagaagtcaaaaaaggaaatgtggtaaaatgctaatatttggggaatgcaggtgagagaattttcttactatgtaaagtacattacttttctataagtctgaaattatatcaacattttatttatttatttatttttgagatggagttttgctcttgacgcccaggttggagtgcaatggcgcaatcttggctcactgcaacctctgcctgccaggttcaagcgattctcctgcctctgcctcccaagtagctaggatcacaggtgcctgccaccatgcccggctaattttttttttttttttttgagacggagtctcactctgttgccaggctggagtgcaatggtgcaatcttggctcactgcaacctctgactcactggttcaagcaattttcctgcctcagcctcccaagtagctgggattacaagcacgcgccaccacgcccagctaattttcatatttttagtagagacggggtttcaccacgttggccagaatggtcttgatctcctgaccttatgatccgcctgcctcagcctcccaaagtgctggaattacaggtgtgagccaccacacctggcctttttaaaaatatttttagtagagacggggtttcaccatgttggccagggtggttttgaactcctgacctcatgtgatccgcccgcctcagcctcccaaagtgctaggattacaggtgtgaaccaccaagcctggccaaaattttaaaaattttttaaggaattggctgggcgcggtggctcacgcctgtaatcccaacactttgggaggctgaggcaggcagatcacgaggtcacgagatgaagaccacactggctaacacagtgaaaccgtgtctctactaaaaatacagaaaattagccaggcgtgctggtgggcgcctgtagtcccagctactggggaggctgaggcaggagaatggcatgaacccgggagtcggagcttgcagttagccgagatcctgccaccgcacttgcactccagcctgggcaacagagtgagactctgtctccaaaaacaaaaaacaaaaaaaaaatttcaaggaattacaaattgaaattaaaataagattcctaacatccccagtccaattatataattttgtattcttaagtattgcaattatatatattatgcatatttcagatgatatgcaaatttcatttactacttattgtttccatattgaggaaaatgttcaatgaaaacagagctcctatcagcacttgcagttcccctccaatacaaatagccccaaaatcaacatattattcccctctttaaggctttctttttactcagaattcaacatgtgaaagtactctctaggttctcaatttgtttaggagattacgagaaaaataggagttttcaggtatttgtgttttgctttttttgagacagagtctcactgtgtcatccaggctggagcacagtggggtgatcttggctcactgcaacctccgtctcccgggttcaagcaattctcatgcctcagcctccggagtacctgagactacaggcacgcgccaccatgtctggctaattttttgtatttttagtagagaaggggtttcactatgttggccaggctcgtctcaaactcctgacctcaagtgatccacccgcctcggcctcacaaagtgctcagattagaggcatgggccacgtgcctggccatgtatttgttttaaataaatctatgatattcacactcacctacacgcctttcaaaagatggtggggggtgggggatgggcaaaactagacttccgaaagatggaagaaaatgggattgcaatttttggccctgcccaagatcctctctttaggcagaatggcctgctcattggctcccgaccagagtcctgaactcccacaacagcctggggtcttcttcctctgtctctactgatttatctttccagtttcagcctgactctctccttagagcttccccaccattcagtccaggaattcctcaccctcgaaggcccagagtatttacttcctgttccactctctgctactcactacggatcatcttgaaccctgttaaccttcaatgggcgtatttttcacatccttccaaaagatcataggctgggctcatttcttctgttctttttatattccctcacagcaaccagtatttacaactaacagatgtttaataaacagctgcaaagctcaacatgccctaatgttttcaatgcaagaatgaaggggaaagaatgcctctgaatgactccaaaagcatgcttggagaaaatggcaaatgtttctgctgcacatttagaggccccagaatacaaatttgcatttgcacgacttcccttttcaatgagaattcaggtacgttctttcattttatcttattagtatgatgagatttgttcttgatgaatccgtaccacctcagctactcgtcatcattccattatcactacgtgtttatagattttcccttttattactcattttattttttccatcaagtatagttcatatacgaggtagtaattaccaggttttctgctccttacacttcaagttcgccaatttttttctgatcataaaagcctaagtgcctattgtcaaaaatcttgaaaacagagaaagtatgaagacgaaaattgtccataatcagtgctgtcttcatatagatattttaaaggaaactgtgacaattatatgtgtttttgggtcttgctacccacccctcagtctacggagcttgcttccatatccttaaatattaatcaagaacattattcttaatggctacacagatttccaccacataatcgtaacacagtttacttaatcttcttatattttaaaaggcgtatggctgatgtttctaattgccttcgtaataagcatacttccttgctaacagaacactcactttattcaaagcacaataccctcagccaaaacctgttgtctgttgtgcccgaggacagtcatatgatgcagtcccagccaatgagatgtaagataaagcaagtgggcggggctttggaggaaacttttaaacaggtggtctttcgtgacgcatgcactctcaccagcctcactttcttgtgcctggagctcagatggaggattttttgattttttttttttttttttttttttttttgagacagtctcactctgtcgctcagcctggagtgcagtggcacaatctcggctcgctgcaaactccgcctcccgggttcacgccattctcctgcctcagcctcccgagtggctgggactacaggcacccgccaccacaccaggctaattttttgtatttttagtggagacggggtttcacggtgttagtcaggatgcgatctcctgacctcgtgatctgcccgcctcggcctcccaaagtgctgagattgtaggcgtgagccaccgcgcctggcctggaggagccatctttagaccatgaggaggcaacaagcgcttggtgagaatggctacatggaaacatagaaggaaagtggatgtctgctgactcagtggaaccttcacttctgcacctgactgccctcctcccaaggctgcttatataaggaaaaatgaaacctctttttttttttgagacagggtctcgctgtgttgcccagggtagactcaaacttctgggctcccagtatcctcctgccacggcctcccaaagtgctggcattgccggcgtaagccaccacaccatgccctcctaactcattaaagccactttggagtgtttctgtgatctatagctgagtggtgtgaaacaaaagaataacctttttttcccccaccttctgctgtcttcatagcctgtgatacagcttcaaaaacaaggaccaagacctacacaccacaactgctggggtcatccagtccaacctgggacagaagtcctggacaggagaggtgtcaggtctctcttcctctgaaagggggctgcctaacctgttgatgctgtgctcccatcaagaagctcacagagaatgatatgggccagtgtttgttccgttttagtgctcatacaactctagctgagattaaccaagaaaactgccccttactggctcagggaactcccatagagaattcccatagggaactcccatagggaattccaaacttacaggccagtaaggtggcctggccgctcttccacctggaacacagctcactgaatacggcagatacctgcagactgggggcagaaactgggctctggatccctttcccagcggggagacctggcttggttgtgagcccagccctgcagggaggctgcagatccaacacagctcctcttggaagccctctgtgccaggaggcacagcccagatgccccgggaatccctgagggaaatttcataaaacatgtgactatctacacagcctgctagaggccagatcattgctcacacggctaagttgaagcctcagtgcagtttctacttcattcagggaactggagttgcagctttcactagaagagctgcttctccttgatgaacaaaccattccgcccataaaaatgctgtggaaagtactgtaaacgctaatgcagccaaaaacttaaagactggtatagggttaactgaactgccacgttaagtcaggtgtaacgagatgacaatgctttaatcctgctgcttaaagcgatgtctaaaatgtgcaagtcaaatttcaagcctttgtaagaacataatggtaaagataatttcatcattatcaggtgatgcaacaacctgcccggtcccagggctggaattccaaacagtcacgcctttgcagagttttacagccctggaagagaggggaggccacagtgaacacctgtgatgataactccagcccatgccccggtgatttttgacaattgaattaatgttgaaatgagcttatttttctgtcctaaagggaaaacgagcctaaaatcctgttaatctagcatcctggttactcagtttcaccataatttataggatagtttttctatccaaaaactaaggctatttttatcccaacttcgccgcttcataaaacacacgtgcatgcatgcaacttcagaggttttggcctaaagcaagttttcaaaataaccgggttcaaatatttcattgagatggtaggggtggaagaatcttatagaagcaaattttactgttctctgtaaattcagacttcttcagccacagatggctcagggatccagtctcgcttgagaaacatgatggaataagcccacagtcagagcttcttctcattcagtttcatgaaagctctgagctcccacaagtgtctgctggaactggacaggaagcttgcaagatgctggctacgattcagcgcagtcaccgccttccccagtcggcccaccatccccagccatccaaccacttcctccccacgaggcatcgcccgttggaaagttttattaaccaaatgcttgagggtttctgtatatttatattacctcctcttctctcctgttctacccaggcatgttgaaaaaaaaaaaagttatgatatactttaataaaaacaaaattaaaatgattaaacctttcatatcctttagagataatctctcttctcctggctggtccaatctggaagaaaacaaatgtgaaccatagcttgctgctgcttttcaatttttttcccccctaaagaaacaaacagaaaaagccgcctgtggccagatttttaaaataaattaaatttgtcctcacacacggcagccaggtgtggttgaaacattctttccagatatctatgatatatgccaacatccttccctctgggggtctttcaacgtgagcctgacaatcccaaggggaacagagacttggcgggggagaaaggggggtgattccaaaatagttattgaaaaagaatcactatttcccaattagccctgtaataatgccttacaggaatgactggatgccctgcccctgcacgccatctaccaaaaccaaaaaatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttggtgttgttgttacaatatctaatagtgagatcaaattcttattgtggaaataaacatcacggtcttctgtatgaagatggtctgcggaaagtgaccacgcatcagagtgtccagcgtaggaggagaatctcagtttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgtactcaaggttgctggagacatggcgcctctatttcctgcccaaagaagcccccttaactgggggccacgggttgagtggtgaaggaggcaactcacacctgaattatagtgggcttgtaaacctgaacagggcaagtcacaactttgggaggctgaggcaggaggatcacttgaggccaggagttcaagaacagccctgacaacatagtgagaccctgtctacaaatgaaaaaactagccaggtgtggtggtgcatgcctgtgctacttggaagactgaggcaggaggatcacttgagcccaggagatggaggctacagtgagccatgattgtgccactgcactccagcctgtgtaaagaccctgtctctacaaaaaaagaaaacaaaaacaaaaacaaaaaaacaaaaaaaactcacctaccaaaagtccagctgacatctactacaaaattcccattattgccataaaaacatgtgggctgggttcaaggctgcatagcagatggccaggctacatcctcatcacacacgcacttcactggtgccagtgccggtgacaggctagaagccactccagtgaggacccctgccagggccaatcagatcagggctgccctccccatgctgtggggcttctcaatgcttctgaaatggactcacacaaggaagtcacaaagggctttggacattaggaaaaccatgcaaactgtttccacttctcagagcaacccgaggcacgcgctctggagtgtgcagagtcacagataactgctgctgctttgctcaccgcagtcttaggatttcttcatttctatcctggagagaatccagcaatggatcacactgttatctagacacaaagaatcccacccctggggcaaagtgctacttgtcccgtggatgagtttgtcagcctgcagcaaggaggccagacgcagtgggaagagcacagccctgggccctgggcctctgtaccaagtccctactctgctgctgtctacagcagccctgtcctcaggaaccttctccagggaaggaaatggcttctgtctgcacatccaatacagcagccactagccacatggcactgagacagatgggccgctgcaatgggaacctagcgacatgagacatccaagattgccaggaagggtccgagttcgcctctgctttatgctcgtgcaggacaggaacggccctgtggaggctgccctcgaggctcacatcacaggctcaatctgggaaagaccagccatgggaagcaggatgtgacttgccctggaagcgcaagtgaaggacgggctccgaatgaaagctacacaaggtaacaatatacacactgggatctttatattatgtccagcctggagtatataacacagggtaaggaaaaaccaaggaattaaaagtccttcaggtacttcgagcaactgaaatcctttggatggaagtccagtcaatcagctggccccctattgaattctataccctaatgggtcatagaaaattgtaaggctctaggtagcatctaccccaaccagagcacaaacaccacacacaagcccagggagatctgcttagtccctaaaagcacagtgggcagcaaggaggggtttctatttcttttttttcttttgagacggagtctcgctctgtcgcccaggttgaagtgcaatggcgcggcctctgctcattgcaacctctgcctcccaggtgcaagtgattctcctgcctcagcctcccgagaagctgggatcacaggcacccgccaccatacctgcctaatttttatatttttagtagaggtggggtttcatcatgttggccaggctggtctccaatacctgagctctagtgatccgcccgcctcggcctcccaaagtgctggattacaggtgtgagccaccatgcccagctaaggagtttttatttctataaatccctccaacaggagcctaacacaggccagcctgctggagcaccttcagcaaaggcagcttttctcgatgctaagaccatcaaatttcacaggcacaagaaccttcctccacgtggccggctgtcagtcctcttggtgtttgccagcaagaaggtttcggtgagggctgtgtgagaacaggcaaggaaagagtcatggtaaaatgggctcagaggacacagggctctgaccccttttcctgtcctaacaagtgtctttgagcacttccggcttcatttggagtccccttccagcgaggtcgcagtagttaatcccatgccaaggccagcactgagaaccgtgtgctgcgagcaggaaaccagagaaggcctggtgggcgctgacagttctgtccgaggcgacttccaggatctccatgacctcccttcatctctcccaccaccttctgtcctaccctcctgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaaactgccggcacctggatcttgaacctttagcgtccagaactgtgagaaaatacacttcttttgtttcagccaaccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggcataaaactataaaaacccatttaacatccactctgaaaaacacatctttacaaagtcctttcaaagtccctcaaaactgctaatggaataagacataagtagcaaaaagcaaaattaaatgcttatttgaagactgttctcccaaactgagaaaaactgtgaaacagagagaaagatcagcaagaaaagatgtaccctatccaggctggcgggaaccacacttctctaaaatgcaagccaaaaaatattaaggaaaatgtagccccaaacctagcctgggtctaccagaagtctgaggaaacccagtgaggaggagctgagcatggtccaacagaaccttctgaactgctctagaaatctgtattgtctaagttaaccatgagccccatggcactattaagcacttgaaatctggttaatatgatgcagaaactggatttaaaattttatttagcattaacagagaattttgagaagcttccttgtggctctcaggagaccagaaagcccaggaaccagggaggtatgggcagcacttagactgaggccacaaaactttccactgctcgtcaatgtttgaaaaaaataatttggaaccataattcttataattgggtcacagtttgaagggggttccttaacatctgtgactctgagaaaaagcctttgagctatttctgtacgcagagagatagatgcatgttctatttcctccctggcccctaccaaggtcgggaacaagtttcatataggatgtaagtagccctagaaatggattctttggacattcctaaagacggtacaggtacaaatcattatttctcgagaaacatccattcaggcagtggagaaagtgtgaactccagaggctaggataggggatccatatgggaggggtctgcacacatggcaggagacagcagaggacggctgccacttcctgctacactgtcggctttaggaggtctctcccctccagtgaaatccagggacagcacccccaaatccagggacagcacccccaactcccagcccagcacaaacacccactgactggctagctatccatattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatcagcaggtacccctttttcctttttttttttttttttttgctgtgccaaaaaaaaccctctctgcagtgagtggccacagtatcaatgcttctcccagtgggcagcgttgggcacgtgctgccacccactcatgaagatagcatggaagacagcctggagcccttgaccaagaacaacactaaccagaagggcagtgtacagctggtgccacgtgtcatatgctgaaacaacacgcacaaaaccctggtagcttcatcatcccagaaaaataacgcaacgaatgaatggtggatctagaacatcaaagaatgagtgaatacgaatcactgcaactcaggccactgcggccaggtctagataactgctgaaaaggtgcaagtcctggaacagccagccaggacacaggaggctgggtacgaggctgcacgctcaacccactgcccacctgaccatcctggtgatgccacaccttctccagggggaccttccagggcagcagcgtctgacagcagtgaaacagcactgcatatgtccaccttccagcagaccagatcattagcatattttgcagagagcaagcagaaaagtttaattgcccttaattactcagttcaacaaggctcctagataatggctctcagatttcttgcctggtatcgacgtaatttccctgactctggcttcattatatccctaacttagaagcaatagcgtctccaagatggctttccagaacagacactgaagtgccagtgaggctgggcagtcgctacaaaggtttcttctatgaggagtcagatttttggccttcacaccactctggggtgtgtgtgtgtgtgtgtgtgtgtgtgtgtgtgtgtgtgtgtgtgtgtgtgtgtgtgtgtgtgtgtgtgtgtgtgtagcgggtagtggggaggacacactagcatatacttaggatggactaagacaaggaatatgtaatcagaagccatcacaattacaaatgtaaatgaacaggcaattggcactgacctttgcagattgttagaggactaattaaggcaaatcaagaactctgttccaacagaaaaacaagacagtatacaccctgagaactactcctatcctctctatgtaaatgcaaaatgcaggagaatcacagagtaatcaaactacgaatattggcaaataaaaaacatctccatgaacaaaagacaaccaagatttacttcttcgtagcctgttagtgattctgctaaaatctctatcaacaagcaccaccaccattctgagcccttgccacacatctgacattctgttagagtccatataaatacatcccaccgccaaaacagccagagacaccagtcactaactccttgcttgaatattttaaaagctgtaagaaaaatacttacaaaaaggaatcaacctatgttatcctgtaaactccatttttcatttaacaacattatgttctcttttcatgttcatacataatgacctctctttacccttgcattgtaaagcatctttctaaaaagcttgctgaaatttacaatccctgtccaaacagtccttcatcagggaatgtcctttagacagataaagtcatgttttccccatgcctccatcaatgcttaaaatttcagtcacccccatttgttttgatgcacttttacatttaacttctctagttaaaaatactttaagttcctataccttccccaaacccggtaaacaagacatacagtaaaaaggaaaggagaaagagcgtgggtgtgctgattttataaaaacaatatttcagaaattcagagctggccacaacatattttagtgctatcagaaaaattacactgaaattgcatataatttagctatttacaaaaaaaaaaaaagatgtactttatatttagagggcagccttacaccaactttgcaaaataaaaacaaaatcaagtgagaaagctgaagacagtatatattcttggtctcttaactcttaagctgtatacattaagcacaacaccctgaaacttggtttaaaaagtgattcatcaaatgaggccagtgagtgttgcagtaaaggctgtcaccaaaaccacattatcacttggcaagctgtgtgcacctctctggccccagaaattcgctactatgaatgccaaagacgtatctgtaaagggaggatactgctttttgctccaagcaaaacaagtctcttaaattctgaatgatcgtgcaccctctgtaaactgagtccgggtccaattatttccaatgcctgagctggtctagtcatcagtgtgtccatattgagagtgcagaggagatcagtgatcagctatgttctccaactcataaaaagccttatatataataggtcgtcaataaagaattgttgaactttaattacatgcatgtaaaatttggaggtctatgtctacatgaaagaaaaagtacttaggacaaggcgagtaagagagaaaacaggaggaggagaaggagaaaggccgacagcagaaacacaaagggcctgtgttctcaaagcccagggcacttgatagaatgaagttaactacagtttcacccaggagccagaaatgccttttaaataagcaaacagggaagctgatcctacacatgacccacctctgagagctctccatttttcaagagcttctggtaaaccagggaagcaaatggcagatgccagcaactcagagctctggcccagtgcattggccagtgatgacgagtggtttctacctgtgggtgggtaagtatgaaatgccgagacgaaatcccaaccaattccagagactacttggtcttgcagaaaaaacactcaagccaataaaaataaattgtggggattggaagaggaacctcacctggttagttactgtctttgagagatgtatttccaagccatttttaaaacaggaaggcccagcaggcttgtgtgcttgtgtctattgtggggtaggggtggaaaagtgtaacgacaaagaccatcacactgaaccaaagacaatttaccacaggactcggcctgcccactgacataagggcagagctccgccatggcagggccacatgggcacagaagcctaactattagcacacagctggcggccaaggctctgtccactggtgcagggcaggacttagatgtacgtgcccaaccacgaggcctctcaaggagttacgtagccagtcatggcagatatagatcctggctgctaccagaagattctgaagggatggaggagacctttgcaatttcttctacctcgactccttcctccagacccacaggttcacatgggttggcaggctacatgatgaactggaccgactggcaaacaagtgacttaagtaacaggtaaactgggaataggtattttttgtcatccacagggcagaaactattgcagaatcatccacagggcagaaactattgcagagttcacccctcctgccttaggaggagacatctagatacctgtaggaggtgacatgagactggggatgaggtccagaactcagaaaggacaaggggttatttctgaagggttttgtgtaatattctgtggcatgtggacaacagaggagaagaggaaaggagaaggaatgtcatcacttagcaggatgatgacagaaagccagaacttccaactctagacagcacagccatggatggggagcttctggtcagagtgggtggggctcctaaaaggtgcaccaagacttcctaatgctcctgatgccacaggatgacatttctagctgaaaaatcatgtcctgacccttatgttaaagaggacagagttgggaatagtctataaagtcgatgtttacaaaatttgaagttgatcatcttaaacatctcaattctaccaggtccataatgtccgttctcttgaagatatcctttcaagttttgaagagccaacccctggggagagggaagatacatcttaagatgagttttcttaaagtggttcctaaaacggaaccaagttcttgttaatgtcaatatgaataaataatacgtaatactttgtcccttttgtcatcagttatatggaccgaactggagcctgtgtgtgggaggggaggagtatggtgtagggagggagtaggggagagagcaaaaacatgactccaggtcaaagccaatcccaaagcatcttgacatacggaagggaagtctatcatctccactgaagttgctcacacacttctcgggggaaaaacccctagtatgcactaaatgagaggaacctcgaaggcactggtgccgggctgcatccacggaagcactacattccaaaacagggaactgtttgttccaggtcaccgactctgggtgaaatggcagctgtacactgtttagtgtggggcacctcattaatacaaaaggaattctgagcagagtaaaagaaagaattgaagggtgaaatggaccagcttttaacagatgattaaaacaatgatgtatgcagagctggccaaaaaaacaccccaaacaaagcacaaaccctgagcaagaaacaggtctaggtgtgttggtagaaagaaggagaatccggggaatgactcaacagtgcactaatgcagagcagcggatcaaacagaggccacaatccctgggtggggcacaggctcccctacagccagatggcccaggggcctcagcctcaggcccatcctcgtcccttactcctgagagtgctcccatgtagacggatgggatcagaggcaaagcagaagctccaccaattaaggtgtttcaactttaaccagaagaggcatttgaaaaacacatggaagggacagtcttgcagtgaccttcaagtgacaaaaattatcccggtacccaacagccctttcctgaacaaacaatttctactgactgtcgaaacctcaaccactctagcaaggagaaaaattcttgaattgtggtctatcccatcatttgggaattgctgtttcatttatatgaggaggcagcgaaggagcagtcagatgatccagagaggagcaggtgggcagagggctttggaggggcttaggagggacgcctccaggaggaaatgaagctgacagaaaaactgatagagcagagcgttcagagattaggaaatgtctacttctggcagagtaaggttcgccatgaattaatcataggtacctagaaaaccagagaaaacaataagttgtacaagaaggtaaatgaaattataaaactctacatggctcagctgcgattaatatttatagttataataatgaaaacactgaatattaatataacccccaattattatttaatcataatggaaggtggagggaggaaggactgagtgtggagggagctggggagtgggagggagtccaactgttgtgtggggggtgcaggagtgtgcggggcagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagcgtggatggaatgtgtaggatgcagagaaagtgtatgtgtgtgcgcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccctggaaaagggggtgggagagggccatgctcttctccataaagtttatgtaactttttgcctttaaaaaatataaaaatgtgtaatttgattatattaaggttaaaactgcacacatccatgatggctgaatggctgagaaggcactgcaggagactgtaggatcaggagtggccttgggtctctggcttggccaggccgttagacaagctgccattaagaagaaaaagaagtgtggcagagaaagtggtgagccaggtgcccaagaggtgggaccaatgagatgtccacgaagctcagcatctgggaggtgggaccagtggtgtccaggaagctgtacaaaggcatttggcagcaccaggacacaaaagctcaagaggctgggagccgaggaccaggccacagtgccctgtgcccagggacatggggcaggctgagaaccaccagccagagtcaggcttgcagaactatcaagggaagtcagaggacaagagaaaaacaccccggaagccaagggaaggcaagggaaggggaagggagcttcaagaaagggctgggcaacaatttcaaacattgcagaaagaaaacagtcaggcccagcaggtcctgggctgtgtcaatcaaagatcagcagcgccctcccaagagtggcttggtgacagaggaaatgggttgtaggaggttgagacatggaatagaggtgagcagttcacagggttctctcaagaatctggaagattctgttgtagagacagtgtggggcctaggatgaaaggagagcttttcttggaaagttttggtttctaaagaggtaagtgactgtcttgtgtgtctaagtggagagcaagagactggaaaattgaaaaaatagaaaagaggaggtgattctacccaatgaagtccctatggaaggcggagtcatgggtggagggagggagggaggtggggaaaaaggtggctgcagggagatgacatggggaggtagaaacgaggcaagctcccactagcaggtctcgacgcattgaagcagcaagcagcatggacccaagaaacacccagaatcactcccaaatacaactgaaatttttataacaagcacttattttattcctctctaaagttcagttttacagaccagactttgaggccacaaattgactactcttaatactgggcaggacacacgatgtagcatctgctttgtcaatttgaaccaataaattgaatctaaagtatgtactggaggaatcttagaatagaggagagtatcttctgttggcctgctccctgggtagtagcttgtgacttccctaagactgagccttgctccaagaaaagtgctgccaatttcctttaaaaaaaaaaaaaaaaaagaagaagaagaagaaagaaaagaaaagaaaaaaagacagaaaggcgggcaggcaacaatccctgcatgttccttccaaaacacaatgctcacctgtgaagtcagtaaggaacatgaggaccagctggatcagtaacgtctccctcaaacagaagtcctctggaggtctcaaggaggtgaacacccaggcccaacctgggcctcccatgcctgtgagaccactcacctgggtccgtggaggggcacctgcggatggtgaagatctgccccaggtcctcgtcctcctctggaaggcccttctgcagccgctgcagctttcgcaggctctcgcttcgctggtgcttcatggagcgcacatgctggatgaggttgagcttggccttggtggagtagttgcacagaacgcagtggtagtagcagctctcaccttctacaccactctcatgctgctgcaggtgctgcaagtaacaaaagagaaagacatgccttgggtaagccactcgaagcggccactggcatcagcccacaccatcctggtcacagccagaggcatgcctccaggggacacatctccacagccaaacaggacagtctttgatatggtttggctgtgtccccgcccaaaatctcatcttgaattctaatctgaactgtaatccccacgtgttggggataggaccttgtgggaggtgattagaatatgggggtggttcccccatgctgttcttgtgatactgagttctcatgagatctgatagttttataaggggcttttccctacttcactcagcacttctccttcctgctgccatgtgaagaaagacatgcctgcttccctttctgccattattgtaagtttcctgaggcctccccacccctgcagaactgtgagtcaatttctttcctttgtaaattacccagtcctaggcagttcttagtagcagcacggtaatggactaatgaggtcttcaactgtgagattccttagagggtttttttttttttttcccccagagtacccagcacccttctctagcagttctttgaaaaaacacagcaagctgatacccattcctatctcccccaaatggccccagccatgtggcttttcagaatgttgataatcctgatcacatgggccctcccagtgcaacaccggctttcctggcacaaggttaaaggtttccccttttattctctaaagtgtcctgctcttgttagatcaggggttggcaaactatggcccacgggccaaattcaacccactgcctgtttttgtaaataaagttttattggaacacagccacgtccattgatttacatactgtctatggatgtttttgaaacatcagagttgaacagttatgacagagatggtatagtccacaaagtctagattattactatagaaatgtgctaaattatgacaggaaaagttaagccaacccctgcttcaggtaatagcctctggtcatcctgcctgtatggcaccctaggtcaggaacatggagccggagctggtatctggctttttcacaagacaactccagtgtttgtatttaaaaccacagtctactgggagaaccccaaattaggttttcacctagattaaaaaatgccagaaaaataaatttctccagactagttccctgtcaatatctcaaagtcccctggcttatcattggccaatatcattggtcagttggtgtatcagatggtcagatggtccaaattacgtcctctgttgtacttagtagacacagtattgatcccagagcatggcagcctaagagcctccaggaggcaggcacagacaggattcatgtctggggtatcagaacagaagaggtcatgatgcagacaggtggcagaccccaggcttctgtggctaggaagacttaaagacgacccaacaacaaaactcacaatgtttctgagtctcctgggaatgtaatgatagctatggaccctttttgactaacagagaatgaatgtgcacctggtgtagaaaggccatctccttcattccaatgattcactttaggggaagagggaattcttccactgggtacacatgaagcaagggaaacactccccaaaagcttaaatgactgacccaaggtaacccagttagttagggggagagagagatgtagaagctgaggcttgtctcctccagccatgtacccagcatccttttgaaggaggaaattcaggtcatgtgagtgctttatgtgctcctgtgattacgtgtccttccttttttctcctcaccacctgtccccaacccccagcccagtcagccaagcctggcccatggagccatggcaggcacacaacaaacgtctcagaactgcccacgttgcttgtctcctttctgacccacactgcttctgtctgatgtttatgccaggataatggtttctagtcctgcttggatgtctcatccttgtccagcttagaatgcaagacactgacaagctagaatggttagaatgccctgcactccacgcaatcctgaaaataccagagtggccctgtgagtgcttcctatcaagggacactgccctgacgctcacgtactgacatgcacacgtcctgtgttcactgatcacgtgtgaaaaatccagaagcatgtttgtactttgctggaagaagaaacataaatgcaccaactaagtgtcacagaaaactcatgggaggggggttgaagccctcaatgacataaactggctaaagtatcccacaggaaatcttgccaacttgtacgtaagaatgggatgagcttcacaggcaccaagaaagaacaatcccttctgcccccaaaatgggtgattcacacactcatatgcagcaccttggacaaagcaaaatttctacaaccagaaagtattggaagaaccagtgagtgcaatgttacctattagaaaaattacaactggtgataaaaagctacttttctggagataaatttgagctgctttttgtttactttttatttattggtttttttttttttttgagacagggtctcactctgttgcccatgctggagtgcaaaggcttaatcttggctcattgcaacctctgcctcctggattcaagcaattctcctgcctcagcctcttgagtagctgggactacaggcataagccaccacacctagctaatttttgtatttttagtagagacagggtttcaccatgttggccaggctggtctcgaactcctgacttcaagcgatccacccgcctcagtctcctaaagtagctgggattataggcgtgagccaccgcacctgacctctgagctgcttttaaaaaatgatttaacctcactgccttctctgtgatgaggttcctttcagaggatgttgggaggatgggatgcactgaggcagtgctttctggaggttacaatcctggggagaaggaaggcagaagtgaagggagaagatgagctagcccacgtcccttcccccaactactccccgaggcccctcagaactcagaagccagaaacaggaccaggatattccaggcagcaagagtttgtcctaaaaccgaggagctggaaacctgtaagggagccaagaactgctgtcttaggtcaccaggaccaaaagaatgatattcattaaagcttcaactaaaactgagtgaataaaagatggcagagacaataaccatgaaattcaaagaaatacgttccatcaagagattttggaggtagaataaactatgaaatcagaccaagaatcactaaagccttacctccaatccccccactacctccctatgaaacaggatttcctcacaataaggcactgaatttcaaacatcaaatttgaatatggatgtgtgagagttctattccaaatggctggagtcttcaatctctgagccacaagagaggaataacatggccagaagagttggatggaaatgcgatgtcaaatgtccaaatccatgggctcttgggtcataggaccgtataaaccctggattgaaataaacatcataccgggtactcacactttaaaaaatggatatgataaaagatattctaaaatccactccacactctagctcatgttggtaaactacaatctcttacactgccatgaattattctgtctgccactttgagagccattttagcaagaaactgggcatgcattacaaatagtggagaaaagaataagaggaaacaagaaaatgaagccacggctgctcccacctaacctggtccagtgaacacctagggttctctcctagaaaattcatgaaagattcattcaaaattccaagcttgctttgtattccaagtttattctccaaaacacttaaaaaaatccagaataggccggatgcagtggctcacacctgtaaacccaggactttgggaggctgaggtgggcacatcacctgaggtcaggagttcaaaaccagcctggccaacatgatgaaaccccgtctctataaaaatacaaaaattagccaggcataatggtgggtgcctgtagtcccagctacttgggaggctgaggcaggaaaatcgcttgaacctgggaggcagaggttgcagtgagccacaatagtgccactgcactccagcctgggcgacagagcaaaactctgtctcaaaaaaaaaaaaaaaaaatccagaataaactatatcttggttgccaggaaacagctgtgcataaacctaacatcccaacccaaacttctgcttgggtctactatgtctacctgcatgtgacaagtcctgctctccccagattttccaagtgtctcgttatttcttaagttgtccaactggaagtaaacagagacccaaagctagcagcaaggtcctgacctctgtgaccttctccacatcattcggccatttcctaggccctgagcggctcaacccgcgaccctgttggtcagatcctctctcccttcctcccaagtggcactggcctcatccccagaatcccacccttggaacctgcctaataaaaagcagtggtagggagtgtgctaagaggcccatgagcactccacggggccagtcagtcagccaagaacatgccttccccgcagaagggagtggatgttttcatttggaggaggagggagaataatttgttcctgacccagctaattagaataccctcaattgggatcacaatgtatttaattaaattcactgtaatatatgaagaatccaccaaggcacaaatcccagtggtgcactcaagaaaggagctgcctgctttcagagttcttgctctcctcgccaggcaggaaatttttctcccacgcaaatcctgaattccccaaccccttccgcctctatcacagagtcacccgctggggaggagggcaaccgggttctgtttttactttttccattttctttactctgtgctcacaattcctacctactctcctttgttgggtcaggagtgtaattttaaaaagaaaacaaaacaacagctccaactgtgggcagtgtgctgggatgcatgccaaccggggacccaaagaaaaccagctggtgagcccatttggcgggggtttgtttcggtttgagtctaagtgtctacaacacgagacactgcatgcacgcgcacacacatgtgagcacacacatgcacacacactatgcccaaccccagggacttaacctgcaggtgatgcaggcagtgtcagcagcaactctaagaaaataaggaagggtataatgagggcattccccctttggcttgaatactgttttgagaatatacttcccggaatactataaaacacaggggcctcctagctaactcaagaaaatccagtatctccccacaaattactaatgagaaagcgagaccaaccagtatcttgaggtcatcctagctaaccaaaaaagagtgagaactcaggtctacccaaactcacttggttgggccaacctctccctataaccttaaatctgactatacttttccttgatcactcccactccaactcacttgcttgtttagaaagcacctggaggccaggcgtggtggctcacgcctgtaatcccaacactgggaggccaaggaaggaggatcacttgagcttaggagttcaagagcagcctgggcaacatggtgagaccccgtctctataaaaagaaataaaaaattagccaagtgtggtggcacatgcctgtagtcttaactacttgggaggctgaggcaggaggatcacttgatcccaggaggtggaggctgaagggaggtatgatcacaccagcgtactccaccctggctcacagagtgagaccctgtctcagtaaatagattagacagactacatagataaacagataggtagattagactagatagatagatagatagacggatagataggtaaaaacagacagatagcacctgcaaaagactggatcataagaactgcaaaggtactgtagctttcacagaaagaaacatctatgcttggcaattgaatttactttctgaaatcttggagaagtatgatgaaggaaggaagtatctagtttgagtcataaatgggagcagaaaaagaacccaacgatctccaagtcctccaaatgctgtgcagcggataacagactgtcctcatctggattaactggaaatttggcacacgttcgggggtcaacagctacggctggaaacgaagccagggttcatacgagggctcactcacgtcagtcaaagagaccttttcttgcacctcttcctaatcctattagggctactcatgttttaaaatgttcatcccgtctcagtttcgctggaagggggacactccaatgcttctgacacgaaaacatctcacggcccccatctgtctctgtgccttcccttctaggtctggctcactgagaagaacacagcaaagccctccctgcaaccagaggcacctcggataaaggggctggcgcgtaacaccaagcacaaaaagcaaactaatcattttaaaagaagggagacaacagaggctccgctgtgcgactttgtgggattctaccccattagtatgttgtgcttgttcagcctcgtcaaacactgaaagtcaaagagacgaaaagagggctcttgttagaaaataatgcatcgtgaaaatcaaaaaaacgtgttcctgttacttgtttcccagggaaaactaaccaacttctgtcagagaacattgatttctataaatctggaggggccccagctccctcctcctccccaacgataggaaacttctaacatctggttcctcatgcatggaatgcaaaatattgatcaggttttgtcaaagcctgccctttaaagtagaaacagacaaagtacattctgacacacacacacaaacatgcacaattcacaaacaaagcttcctcaggagtaccacctgttactacagacacacccgtggccgccctctcggcacactgtgctgtgcacacaggcacacacggcaactccatttccagagcagcccctctgagccagggggctattccaggagatgcgaggtgcttcctgcccagcagaggagaaaccccatggtggaatgtcccagaaaacccctgagacacctgtcaggccaaaggcaggcaggagagcctgtctgtaactcttctcagtccattgaactggaggccccatgatggaagaagctgcccgttacagcacccctgtccagggaaagacagcaaccacagcacgcaacagcttcagcttctcgcttcagggagaggactatgtaatctcactaacaaacctggtgagagggatggggagaagatggggaccagtaagtctgctaattcctcaacttgataagatgaagtaggaagacatagcgggtgttcattcaccatcatatgcatgcagagcatttactgtgggtgcggcatctacacacatactttttttcttttttgtctgagaaagggtctcactctatcatccaggatggagtgcagtggtgcgatcatggcttactacagcctcaacctccccaggctgaggtgatcctcccacctcagcttcctgagtagctgggactataggtgcgtgccatcatgcctggctaatttttaaattttttgtagagacagagtctgaccaatttgcccaggctggtctcaaactcctgggctcaaagaatcctcccacttcagcctcccaaagtgctaggattatagatgtaagtcaccgcacccagcctacacacacttttaaattttcacattacaaccccatgaggtgggtcacatttggttttcatccttggaggagcccaaagctcaaagaagccacatgactcctgcaaggtcacacagagcatggaggaaacaggaccagagcctgagacttgagtccaagtaccaagtccacagccgccaagctacgctgcacagactgcagggggttctggaacatgagactctgcagacccaggtgttcaccttgaatgcctaaaattaaaaagaaaatccttccaggggtaacgcaaccaggagtgggggaggttaattttttaatcagtcagatcgcgttatagttccaaatgtaatgtcacatttttaggaagactcctggaaggtcaacctaaatatatatgtatattctgttcaatgctggctttttatctgctcaagctctcgtccttgacgcatgctaatttagttctatttcattgtaggatccctgcagacaccataagatagaagccccaaccatgatttataagaaaaaagtaaaaggaagtaaaaatgttcccttagatcaatccatttgggttgctctgacctagtttctggtttctaggccaggctccttaggccgtggaacaagccatgattgctcactctccgtatccaaggccagagcggagacttcccgttcctctatcttttcccttgcacgaatcacatttcctgattcaaaattctcaacattagtggccttgagaaaaacagttaagttctagaaggaaaataactaagtctatagctgtctataggttgtacctgccttggctttgactctttcctggaaaaacacaaacatggatccttgtggaatgtcgacgcctccatgtaaacagatttcacttccctctgctaggagaactccacaaaggagtgtggagccactgtttatacatggggaggaaatttatcaggcatgcatttttaccattatgggagcaaattattaaccctgtctcaaaaaaaaaaaaaaaaaagtgtgtgtaggtgcttcgcccatagtaaatgctatgcatgcatatgatggtgaatgaacaccccctacatcttccttatttcatggtaggaccctgaggaaggggcctaccagatcataatgtcacaagcaaaatgaggactggtttccacaatggctgagtgagtgtgcacagagctcagaagctgaggggggtatgtaggtggataaaacaacaaagtgggtcccaccaagctaacctcaaactactctccagaaacaacctagagcttccagaatctgacaatcacctcttcactaggatatcatatcaggaacagcaactttcttcatttgtaagatgtacttcttccctagcactattttccagctttcccaaatttaggtccccatacaaaaataaaagcctcctgatatagtttggctgtgtccccacgcaaatctcatcttgaagtgtagtccccataatccccatgtatcatggtagggatctggtgggaggtaactgaatcatgggtgcagttacccctgctgctgttcttgtgacagcgagttctcatgagatctgatggttttataaagggcttccccactccttcactctgcacttctcttcctgctgccatgtgaaaaaggacatgtttgctcccctttccatcatgattgtaagttttctgaggcctccccagccatgctgaatggtgagtcaattaaacctctttcctttaaaaatcacccagtctcgggtatgtctttattaatagcgtgagaacgaactaatacaccgccatatacacattactctagcttgtgctcatccaactccacgtcaaactgttgccaataatgatggtttgtggggcactctagattaagcagcccagttgaaaaccctcactctgaatctcactagctgtgccacgtagggcaagtcacatacactgttgggtctcggtttccttgtgtgcaaaacagggacaataacagagcctcatttcactgctgggaggattcaatgggataattcatataaaatgtgtctgatacacggttagccttcataataaatgaggctattactaatgttatttttcatcagttaatcttcaggattagggatggaaacgaacatctactgaacatacctatttgttatttctctccttacaaccaaccctcactcctccccaggctccaaaaggcaatccttggttgacaataaagaaactgatatataggaattatgacatggacagaggatactgaacacacacagggctgccttcacccttacaagaagtgcaaaacttgccaaagtcaggctgttggtgtaggcagagcccagatccaaagcttaagcccatgcccttgccaaaaaaaaaaaaaaaaaaacaagaagtgtttactgggtctgtttgcccatcagggcaccaatgtaataaaatgcaaggaccacgttctttctcatgtctgccaatatcctgggtgaggagcagggaagggaggagagttcggctgaaatgcctggaagacacttccccgattctccaaatccactcaagaatttgcttatttgtatctccaatcccatgacagtcaatccagcagaaaaaaacacgtgtctactggtcaaaacgggtgtgctacttcatctataacctggagatattttacttgccctgtcttacacaaagcaattttaaaaaccgcatgagaaaacttccacatatgtgaaaatccttcggaacatgtgaagaactacccaaatatttgagacagtgatggtctttctactgtaagtccagatgttgcttcgtcgcttctgatgggcacgtacagccaggtgggcttggtgatggatgatgccactggtgttccagctcagtggttctctaacttgagcgtgcatcggaagcacctgggaggcatgctacgccctagatcgctggggccatcccaagggtttctgattcagagggtctggagtgagccccaagaatctgcatttctaacagtctcccaggtcatcatgacgccgatctgggaccacactttgagaaccgatgctctggccaggacagcaatggccacggaaaaaggacccaagtcggaatacctggagatgttctgttgcagggaggaaaatttccaagaccaaaaatctctgcacttggcttttcccaaagagtatcttaaattctagcaaactgcacttgataaatcatgcaatgcctgcacacaagaattcacctccttaatgaaaaagtcacacggaagcagctgcctgctactggcctgctccagatacttcataaaagtcagaattggctctattcatcttcctctcccctttcacacctgcactcgaaaatttcccagggctgtcgctggcagcgtggctcttgatgggaaagcatgaggcatcattttttcctcccttgctctgcagcccgctgagtgcacctgcccagatgtcttgctggaaccgagcctacagaagaatttcaaccaaatgcgagaggaaaatgctctttaaaactcctcccatgctcttcaactttctggttgttgctgcagagcatgaatttggtgctcaaacccagaggctcctcttgagttcctactatttgctgacaaatacattcatcaccttcataatgagagaagacagggcagccggcgcaacacaagcaggaggtaagcagcacccacaaggctgccttctgcctcgtacaaggggcttgattttttattttattcttctcttaaaagagagaatgagaaagtgacggggcgaggcagaaaaactccctctaaatcaacacttctggcgtcgatcactctggctgatgcagacatttcactttttctccttaaattccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggacggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccgatattgttccgcctcaagatggagagctcagcatggattttactgaacgttaaatcaaccagcaagcgcagccagcaaactctgtggcactttaactttaaataatgcaataattattgaatttcctttttataactgaagtgctggaatgtaaacaatggggctgtaattgcaggaaggggggatcaatagaggcaatcgttttcaaccatgttaattgtaaatacaattgctccaagatgtcagccttgttcttcttgctcccagaatcatcctaacggatgacagagtccaactttcccattacagctgttcgttcctttaagaggttctcaatcaggtctgatcaatctgtcaagataatgcatggagtaagtaagactcttccaaacacaggctcccaatcaatagcccggaccagcttaatgaggtggggctgaggcccagagggaggtaacagcccccagcttgcgcctgggtttggcaggctggcttcctcgcatggccctgataaacagatcagcccttaatgaggacattagttatgcatgcttcagcaagcagcaaggcacccgtccctggggacagacggacagaaaacaaaatagattaacagaaaacaacatggtaccaaattaggtctcactgaagacttttccctccttttcctgctttccttaattgtccagcagagtggaggacaccaattaatcattccaatgggcctgagcgcaaagacctatgggcatcccctggggtagaggatctcaagctgtccctgaatatgagcaccctcatttttgagacaccgttttcagagcacaaaggggctgacggggggctgaggagcctttcatggacgggccttagcaccaaacagccagagagatggaggacaaggctgaacctcaaagtctgacagtcgcgcaggccagccgggggctaaagttggacaggaacaaaaaccgccactctgaggctgatgtccaagtttctgaggccaagtcttggtcttgagaatggttattccttccagatgaggatgtgggaagtcaggagtcttgaatgcaactgcacccagcccggtactgcaggagtctgaattctcaccaggataaccagagagggctctatggggaacccatgaggaagggacaccatcttcccttcctcagaggccgctgtgcatttgttcctgctgcgagagttcgaggagggtgcccactgtggaggtcgttgagaaaggcccatgctaagggcaggtcccgccaagaatccagcagttcctttcatgcttggcttagagcagggagttctcaaagtgtggctcctcaaccaacagcaacagcaccctctgggaatgtcagatgtgcaaattctcagaccctgtccagatcgacagaaactctagggatggggccaggaatgtggcttttaacaagccctctaggcgattctgaggcaagctcacttggtggccactgtcttacagtgggggttagacaaggcaggcttctagtagggataacctcctcatatgttacatggagttggacctttctggatcggaaatagtccagatgcccaagatatagctagaaaaccgtattcttactgaggtttggctcagaggaggaactattattctagcccaccacccatctgctccagaatgcaaggcccccgggaaaaataaaaccaaaagaacacagaggcccttgtgacaactccattttattagttgagaaagatcatgaaatgggtcgcactactgaatttcagaagttaacagtctcatattgtgacagaagtaaaaacgagaataactgggtcttttgaaagctctaagggatcagcagactaagagaaaataaatataccgctagaaagatcagatccctgcactatgcagagacccagctcacagaccactcctactccaaagctgtccccaagccccaggctccatcgcttcctcctctgggcccttcagcccactggaagcagctcctatgctgtgcgtgttgcaaaccacctttgctcctccgccacaccatcaacagcatcccacaggctgggaccaagtcgaatatttctatcctcagttctcagcacagctcctgattcatggcagggacttaaaaactgtagtggctcacgcctataatcctagcactgtgggaggccaaggtgggtggatcacttgaggccagaagttagagaccagcttggccaacatggcaaaaccccacctctaccaaaaatacaaaaattagccgggcgtggtggcaggctcctataatcccagctacttgggaggctgaggcaggagaatttcttgaacacaggaggtggaggtcgcagtgagccgagatcacaacccactgcactccagcctggcaacagagtgagattctgtctcaaaataaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacttgcaattagacttgtgtcagttcccaccttccccaccaactatgatctttctggtctcagtgccttttcttgctgggaaaccctcccagataactctgacccatgctgaaatgcctcacatctcctacggcaggctggtggcacctgcgcctggaaggctttatgcattgcacctgagctaaaacagtggctccttgcctgtggggggggtcccacagcaccaggtggtcccgatcagggcccaccacaaagcattctcttttttctttctttctgagatgggagtctcactctgtcacccaggctagagtgcagtagtgccatcttggctcactgcaacctccatctcctgggttcaagtgactctcctgcctcagcctcctaagtagctaagattacaggtgcccgccaccatgcccagctaatttttgtatttttgcatttttggtagagacggggtttcatcatgttggccaggctggtctcgaactcctaacctcaagtgatccgcccaccaaggcctcccaaagtgctgggattacaggcatgagccactacacccggccctttcttttgtgtagatgcttcacttgatttctacacggggctctctgtccctcaatgactgagatgggaggttgggggctgaagagaataaaaatgtttgctaatatttattgcttgtttaaataagatttaatgacaggagataattacactaaatggctttattcagtgacttgaatttttttagtatgtgaatcacaaaagggctcgcccctccccaccaatcagccacaatgtcccccagccagaggacaactgagttggtcctcctcattccattcctccatttcttctacatccctagctatgttatttacataggtttactatcactatgctcctttactattaaactgacaaataattgcaagattcaggtatctgagcaccatcgagacgatcaagaccacagaagaaaggaagagggagtacactccgcagatgcctcccagggggagtaactcaggctgtcagaattctacatgtgtgcgggcagtgttcaccacacacacctttgcagataaaaagaatgtggtacatattttagttctaaacataaaatgtccacccaagccaacagagtggtgtgaaagtgttcagatacctggaaggcagtggccacacaggcattcctagaacataagacagcttgtctacagctccgatgagtcagaatgagggggacatcttttcaatacacacatcacacgtacaactttattttcttcctgaatttcctgtcctcctaatctaactgttgccagggactgctgctgactggatccccaagtcatataacccacgtggttaaggctctcaccttcctctactctccattctaggacctaggaggaatggaccattctctacatggggtcagagttgcatgttcagatgtgattccttccctctccagctacgcccaaactctgggatctccagccttctgactggccaaccccccgataagatccctcccgggacatccaagcaattcgatccaaagatgccgcctcctggttggtcagctctccagctcctagtggaatgagactggaaggccggcccgggaaaacgttttaaaacttatttttaagtggcaaaatacagggagaattttcaccagccagtccacactggccaaaacatcccctgcttacactcagtaagttcactgtactgcaggcccaagaaacagtgatgacacaggaagaagccgtggtcgatgatcgcactgggggggcatgggaccggggtggggagcatcgccaatcttattccagacagatgatagtttacaaaaccttctggagaactgtgaggaatttccttcagtaaaaatcaagtcttcagaaaactgcaccaaaaaagctggccgggcatggtggctcacacctataaatcccagcactatgggaggccgaggcaggcggatcacctgaggtcaggagttcgagaccagcctggccaacatggtaaaaccctgtttctacaaaaaagtacaaaaattagccaggcatggtggcacgcgcccgcagtcccaacaactcaggaggctgatgcaggagaatcacttgagcctgggagctggaggttacagtgagccgagatcatgccactgcactccagactgggcaacagagcgagactctgtccaccccccttccccccctcaaaaaactaatgactgggaaaattttctttgagcaaaatggtaggagttggggaggagcaaaggaggtgggtggaagcgaggactagagagaggactgcccagaccctgccaggtggaaagcatcaggacacatcacgcatgctacaagtttttatgtgacgcgtgcacagtggcatgtggacacagacctggccgtgctttctcccggggctacagtattaagatgcagtcaatcgctcaccatcacaccagtgggcaagtgatgtctttttggaatctcaaatccagtagcctgctctgctagccttaatctagtcagtctatggacgcttttatattagtaggtattttaaaggcttaagtcttaaaacacaaatctttcgatgacctttccagatgactctataatagcataaggccagaggaaacagcagcagccagtctcaggttctggtagcactggtatttttataatggtctttcttccggctttgattcattcattcattccccgtgtgtctgtctacattcctgctgcttctttcctcacgctctaatctctccccaaaatgagtgttcatcaatcacctctaaaaattatcctcatcattctctgtacgtgagaaaggcctttcactaaagggtctttatcacccactactcccctgtaccacccctgtctccagccagcagctctaccggttctcggtttccaaaggtttcctctatttgtgtgtgtgtgtgtgtgtgtgtgtgtgtgtgtgtgtgtgtgtgtgtgtgtgtgtgtgtgttgtgtgtatgcacacaggtgcaggctcaggccacttcctcctgtgtacaagtccatgctagatcctccaaattccttttttttttttttgatggggtctcattcttgtcacccaagctggagttcagtggcaggtggcaggatctcggctcactgctacctctgagtcccaggctcaagtgatcctcccacctctgcctccagagtagctgggaccacaggcccgtgctaccatgcccagctaatttttgtatttttagtagagatggggtctcatcatcttgaccaggctggtctcaaactcctggcctcaagtgattcacctgcctcggcctcccaaagtgctgggattacagcattagccaccgtgcccagcccctgctcctccaaattctatcctcctttctaagcatctcacctcccgccctttttctgtctgcagcgatcctttctcctctgaactccaagtcttgggctctcagcacggctatgggcactgctgccctgagtgctggtaatcagctttatgtatgtggcacaccccccagtgagactggaaggttcctgagggcagagatgctatgccctcctccctggggattgacacacaggagccacgtcattctgcagtgagaacatgggaatgggagtgagcagccgtggagaagagggaggactgacgctgagctttctcttccattgtaaaaggaggaatagggccacctacctcaccaggggccatgaggcttgagtgagaaaatcagtatgaatgaacttccttaaacaataaagcaaaattaaaacaaaacagctgctcaggtgacgacaatgggtggaaaggggaacttgaagattcaggacgcctcccctgccatctgatttcatcagggtcctaggactgactacacaaagaggaattgattacttgatcgtccgttcacttaccttgctaatgaaatcattgggtttttctggggaagaacctgttaggaggactggcttgcctctgggtgtcagtcccgctggtgccagctgcatccccaatgccaacatgactcatgcgatgacacaaattgccattgggctttgttattatgtgaccttcagcaagttacccgcccgtccctgctccagtgctaaaatcagcacggcgatacgagaacctacttcaaggcatcatcatgaggaacgatgatgaagcagctaataatgactgggaaacactttgtctttgtaaagagccatattacttaacatttagaataatacccactgtttcaggttgagaaagcattcagattttagctaaactgaaggctgagcacatccactaatgagcactgtccttcccatagaaacggcgaaagctactcagtctgctgaataaaatgactagcagtacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataatgtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtctcaactactcaattctgccacggcagcacataaaagaataggcatgactgtgttccaataaaactttatttatggagacaaatggctggctgtattccctcctctggcagtgatatgctgttccctgacctaaaaccccgtaacaaatttatacaatcatttagaaaaatcacgcgcctgctctcaataaagggaacatatacattatctttctctcacacacaccctcttaaacacactctttgataagcaaaataagtttcttacaatttttgaaactcaagttaagagccaggctcaggccgggtgcggtataatcccagcactttgggaggctgaggtgggaggatcgcttgagctcaggagttcgagaccagcctgggcaacgtggtgaaaccctgtttctacaaaaaaatacaaaaattagctgggcatggtggcgtgcacctgcagtcccagctacttggagggctgaggcaggaggatcacttgaccctgggaagttgaggccgcaatgagccaagatcgtgccactgcactctaccctgggtgacaaagtgacaccgtgtctcaaaaaaaaaaaaaaaaaaaaaaattaaaaagccaggcttgcaaacttcatatgcaaataagctgtttcaacgtgaaagtcaacacctatttaagagccatttaactttcaattacgaaatgaattcagaacaattcaacttcactgcttgttttcaaggctttcgaacctaactttctcgtcagtgtgctcagtcacagggcactggttctcaggttctgcatctcactctacaatcaaggtaaataccaccacaggaataagggttaaggttatacacttattcagagcttaacaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtgatcaggaaatctggattgagaaaaatgaagtatttaggtgttttctcaataacatcatcttacatgtacacagtcctgcgtagatttcaaagggtttggccattacacagctcaaatgattctcataagcaccttgagacattaggcagtggatggcagcgtggcagatggctttctcctctgtttaatggacacaggagagagataatctagagatggcaaattggcagtggctgagaagcctgcaggtgggagcttcataaccctcgggagtttttaaaaatgcttaattaatggtgaacatttaaaaatctgccaatttcccatacaatcaagattttttgcctctttagacattaaaaaacaaaacaaaacaaaaaaacagggtttctggctgtacattccctcatgtcagcaattacctagaaaagatggtgcaggagccctccagccccacaccagttacccacttctgatacctgtatggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagccagcttaattctgccacaggagttaatatttgttaattggtagaaaaaggtaaaattaatgaggaagttagcatagctatttaaaaacagctccatgtttcccccactgtaacacatggaactatcaggaagtaattgagggaaaaggacactgtcaattctcaattatctgcatgaatgaagcgctcagtgacacggataatccaagtcacttacatttggatttagaaagtaacatctttttccttcggaaaacttaccttcctaattagggcttgctgaatgcagtggcgaaatcagtttaccttctcggtcagagaaacaacgtgtcggggaaggtttggaaacggctgggcatttcagaccctccgcggataacccagggcagataaaagatcattcacagaggctggccaatatagcagccactagccacatgtgactatttaaatttaaattaagttaaataaaatgaaaagttcaatccctcggtgacactagccacatttcaagtgctcgatggccccgtgtggctggtggccaccacgctggacagcacagatcacagaacatttccatcatcacagaaagttctagtggacggtgctgaattctagaccaacaatcacatctagttacctggattaagtagaaagcagagggcagggggagagggatgcgggagacgtcacactgccactttagaaacaaaagggaattgtaactccggactctctcagctagtttaatttcaagcccggtaatgtagacgctgtctagggaataacataaaaaataagcattccattctaagtaaaatgaggctttttaattaacaaagcagaaaacgggaggataaaaggcgaggcaggaaaggctgattttcagcaaacatgtgccattgctgcctgtacccagcatggccatgcagcccagacgctggctgaagggtagacaaaggcaggagctcgaccctgccaggctccgcgcggggaggtgcctgctcaggtgccgctgggagcaatgtcaggcccagtgtcacttaacatcctcattaattatcttgaaaggagagggttagtaaacagcaagttaattaaattctcagatgatgctaatttgggaggctttagaaagactggcaagggcagtggcaatataaatgggacctgggtgggttggaggtatgagtggaaataacattaagcgctggccaaacgctgctcttaaataagtcttatggaagagccaaaatacatctgaaaagaaacttatttggaaaattgttgcaggaaagctaaaaggttggaagcttctaaggcgtatgatcagaatgggagtcaaaaaggctttttaagactttgaataaaactgtttacgtgcacttagaggtctgggagaaacagcagctcctaagggttgctgtccttgggagggaggataggagcgaatggggagcagggatggggcttgcacttttacttccttttcttctaaatgaattaaagatttttattattattttattattattttttagacagagtctccctctgtcgccagcctagagtgcagtggggccatctcagctcattgcaacctctgcctcccaggttcaagcgacttcccggcctcagtctcccaagtagctgggactataagcacacaccaccacacctggctaatttttgtatttttagtagagacggggtttcaccacgttggccagaatggtctcaatctcctgacctcatgatccgcctacctcagcctccgaaagtgttgggattacaggcgtgagccaccacgcccagccctaattaaagatttgtaaaacaggcctggtttttgaattctgattttgaaatttttgtgtctgaaataacattagatttatagaagagttgtaaagatacaatgagttcccatgtgcccttcacacagctgcctctaatgtcaacatcttccatcttaacagctgggacactgtcaaagcaaagaaatgagcattgctacaatactatgaccaagctacagactttattcagatgccaccagtttttctactcaaggcctttctctggtccaggatccaaaccatgtccctgcatagcactgaaatgtcattctcctccatcgcctccaatctgtctttccttgtcctgaaagacctgggcgcttctgacaggggcaggtcagtagaggacccctcagtgtgggtttgtctgatgttttctcacaattagattgagattatggatttctggagagaatgccaccaaggggaaggacccttcccatccaccgtatcacatcaggggctatgtgacatcaacatgacccatcactggtgatgttgaccttgatcactttgttaaggtgacatctgctgggtttctccaagggtaagttaacacttttctttctccagactttactcattaaaaagagtcactaagcccagcccacacttaagggcaggggagtgaagctccaccttctggttattacgctgttaataaaataaaaacatctcgtaaaagagataaacttctctttatgcaaacaaaggtggctaatggaaatgtctatctagaaagtcagagtttgttgtctttgttttgcatacctgggctctcgacaatggaaatgaagcaatgccaagagattcagggccctcacagtgccaggccaggtgctgtgtagctatagatattagcccatttaatccccaccacagccagatgaatgagatggcacaagattacaacaatcctcccaaatgacagtaggtgaaatgtggaaccaagaggttaaatcacttgctcgtgttaacacagctatgaagggacagaggcgggatctgaacccaggccccctggctctagagatcatgctgtctagagacctctctgctatcctgcttcttgatatacaactctgaaatttcagggcagttaaaatgcggcagcaccatgtcactcccacagtggcactgtgagtgacagcgctaaggaggcccaacaaaaccaagatggtctggagggttttcaacagaagacagtccgccttcatctctatagtgtggcagagaatccagaacacattagcttggctaaggacctccctctctacaaacaggtatggaagaagctcagaacccacagaccacgatacttactcccatctcagcccctatctactacagacacaaacttggaactgtctccaaaaacatttagagttcactgtgacaaagcaataaagctcagaggtcaggaaaaaagcgatcagcaggcagacttgggggagaaacttggcccacaacacccccgatctacaacctgcaaatatttactcatgggcttgtttaatcctaacatttgatgttctgacattaaaaaagaaacaaggaagctcttgcttctagagaaacaagaaaggaacaaggaatgtttgggtaagaactgctgcattcttacccaaaagaataacataggctaggctgggtgcggtggctcatgcctataatcccagcactttgggggctgaggcaggcaggtcacttgaggtcaggactttgagacaagcttggccaatacggtgaaaccctgtctctactaaaaatacaaaaattagttgggtgtgatggtgtgcgcctatagtcccagctactcgggtggctgaggcaggagaattgcttgaatctgggaggcagaggttgcagtgagctgagatcacactactgcactctagcctgggcgacagagtgagactccatctaaaagcaaacaaacaaacaacaacaacaaaaacacataggctaacaagtagcctacgttattcaaaattcaaaattccagtactgatctttaccatcatcctgtccacagagaaaagatgatgaagtgtgtaggaagcaacaaatgtcccctacctgcacacccgccccacactggattctccaaatatctggcatttatttctcctccatttaaccctgtcttttgttttcccattgtgtcaactgcaaaaatttgcctttaaaaaaatgacactaataaagaatcacaccatacaaattctaatactatattgatcccatcagtgactgggcagacagcagatcttccatcaacacctagactcgcagaacacatcaaacagaaggctctcgacacccagtgtccgggatcagcgtggcgggcctctgctccaacctgtccacccaactagatctcaagaggaaaacagaattgccacctctcaagactgaggctacgtgcagtggctcacacttgtaaccccggcactcctggatgccaaggctcaagaggagcccaggaagtcgagaccagcctgggcaacaaggcaagatccagtctctacaaaaaataaaaaaaattagccaggtgtgtggtacatgcatgcctgtggttccagctactccggaggctgagggaggaggatcacttgagcccaagaggtcaaggctccagtgagccgtgtttgtgccactgcactccagcctctgtgacagagcaagactctgtcataaaaaaaaaaaaaaggctgaatttcattgtgattttaaaagcacatataatcattttataaaatgcagaaaagtgttattaataagttaatctctgagtgcttactatgtgccaggcacagttccaacgcccattctaagaatcacccactctagacgtaactacttaacatttcaaagtattcttttccatgcatttcaacgtttcacttcagccagaaaacataaaatagcattgaagagaggcatattttctgatttttaatggcatcagaagctggaaatgacggactggaatagtatacgtggcaaaaatctaaaataattaagaagatgtttgtaagcacttagaaaagagagcagtgaatcacttacagagcaagagactgacttcttccttgactcttcacttcccccccctcctccgcctttctttttctcaaataaggtgactactgctgttattactaacaccgaactgggagatcagggactattaaagattaatgacatttgattttgtatctcatgatatgcttgtgaacaatctggaatggggggatctaattatactatggtaagaggtctctgtacttaaaaatgttggcccagagaatgctgatgataaatcaaagtcaacatggaggaaaatgcctgcagtaaaatataattatccaggtggacctctcctgtccagcgtttctaataagatgtgaacagagacagaagtcatgcctatcacccaacaaagttagtcaaaaagtcatatggggaagaaacaggtgaaatgtaaatcatttgtacgaattgactaacgaggattattatattttaataccaggcagtgcaaaactaaacaatggagacagttctgtatggccccaagaaaaggcgaattaataaaaaaagaaaatgtctagaaacagatccaaatgagaacttcatgtatgatatagtggcatttctaggcaccacggcaaaggatgggtagattgcttaataaacatggcagggacagataattgagaaaaaaataaatagaggaacccctatctcacagtatataccaaaataaactccagatggataacagagttaagtgtcaaaacatgaaaccatgaaagactaaaaggggatggagtgaatgtgatcttggcaggggaaagacagttctaagcttaacaaagcagaagaaggccaggtgcagtggctcacacctgtaatcccagcaccttgagaggcccaggcaggtggattgcttgagccaaggagttcgagaccagcctgaacaacatggtgaaaccccatcgctacaaaaaaaacacaaaaattagccaggtatcatggcacgcgcctatagtcctggctattcaggaggctgaggtggaaggattacttgattccagaaggccgaggctacagcgagccatgatcacaccactgcactccagactgggtgacagagcaacaccctgtctcaataaataaataaacaaacaaaggagaaggaagcaaaaatgagaagttttcgccatgtaaaatttcgaaactttggaatctcaaaacataccataaacagcaaaagataatgataaactgggggaaaggtagacagtaacacaaatacataaatacatgtttaacacctttgatagagaaagagctattttaatttgtttatattatccatctatgaacgtttaatttataacagtgaaaaactggaaacaagccgactatcaaacgcccagtaactaaattgcagcaccttcataccacggggtgtttggtgcagctatcaaaaatcatgttgtagaaaacatctagtgacatccaaaaaaggtcacacattgtaaagctttttagaagccagttacaagatacacacagtatcatttcaattctacgaaataataatatcacatctgtacagaagaggccaaaatgacatataccaaaatgtttaaaatttaaagcatcttggtagtgaaattagggatgattttttgtgtgtgtgtctctgcatttccaaaattttttttacatacaataaacatgaagcacttttgaactcaaaattaataaaaataattaagtggaaatatatatgtgtgtatataaagacgatcaccttactgttacattttcagatattataaacttgagagggcagccagctagcccactgagtcaatggaataaacacgatgaagaaaaacagcaataaatgtcaagttccttccccaggttgaggggacaaggaggcctggtttaactgtcagttccatgagggcttgagatggctgcttaataaaagactagaacattaatgacttggtgtctatatcaaggaaagggacagactccctgtgatccacacgagtgaggcctcgccaaaagaccacgtcccatcaaaggcatcatcattcaagggacctgtcaacaagcaaataagtcaaaagcagggggcaaggatggtaaggggtttggaaaccatataaagaatagtcacaagtgcttgagatttgcattcaggaggatggggacggtacatacacatgaagacaagagacaagaaaaggagggacaattagctaaactgcttatggcatcttcatacaataatactacgcagctattaaaaattatgatggaaaaaatagtgacattcaaaaaatcaaatattgcaaagttttaaaaagtcacaaaaaccagtatcctttaaacacttacaaaatcatcatatcacaaggaagatgtctcttctagaagaggaacaggacaaaagtatctctacccctgcaggtaactaggcagccagtaactcaacataaaggatgggctttatgataattaaaggtggccctggactcctttgtataaagaaatggaaatgttcagagaatctctatgacctttgtttaaaggtagttctttttttttttttttttttaaatggagccttgctctgtctcccaggctggagcgcagtggtgaaatctcggctcactgcaagctctgcctcccgcgttcacaccattctcctgcctcagcctcctgagtagctgggattacaggcacccgccaccatgcccagctaatttttttgtatttttagtagaaatggggtttcactgtgttagccaggatggtctcgatctcctgacctcatgatcttcctgcctcggcctcccaaagtgctgggattacaggcgtgagccaccgcacccggcctgtttagaggtatttctatacgatgttcctttgctgggttcagtgtgttccctaaatgcgggtagatgtgcctggaggttgttaaaaacacagattctgtgcatttccctaatccaggctcacaggatcagtctctcaggcaggacctcagctcagattctgtactttttttttttttagagacagggtctcactctgttgcccaggctggagtgtgcagaggtatagtcacagctcactgcagcctggaactcccaggctcaagcgattctcccacctcagcctcccaagtagctaggactacaggcgtgcaccaccacacctggctaatttttgtatttttttgtagagatgggggtttcaccatgctacgcaggctgttcttgaactcctgagctcaagtgatctatctgccttggcctcccaaagtgctgcgactacaggtgtgagccagtgtgcccagcatattttgtacttcaaagggttctctcactgattctgacgcacagctaggtttaagaatccttgagccaggtggtatctttatttttaagaaagatctgttttgtttttttttaaggcagtacagaaagaaatgtataaatcatcacattctatcactaatgtgaacattttttaccaatatccatcttgatatctcctgtctatctatctaaaatatacctccaattttacataaacgcaatgatctgtatatgtaacatttttatactatgttgagagaggccgtctttccaactaaaacatgtatatgcaccatcttttttttttttttttttttttttttttttttgagacagagttcttcactctgttgccagggctggagtgcagtggcacgatctcagctcactgcaacctctacctcccaggttcaagcgattctcctgcctcagcctcccaagaacctgggattacaggcacccggtactatgcccagctaattttttgtatttttagtagagacggggtttcactatgttgaccaggctggtctcaaactcctgaccttgtgattcacccgccttggcctctcaaagtgctgggattacaggcatgagctactgcgcccggtccctgcatcaccatttttaatacctgcactgtaagccacaagaacatgctgtaattatcttaactagtccaactgaagaatttgccaacttaaaaaaaaataaccaaaataaacaatgttgtgaagaagagcatctcatacatatcaacacccagaagtcactgggcctcagcacagaattagcccactttacactgtgatagctatcagtggaaaaattaaactaatacacacagccaccaacagggtacatgagcccctggattccattatgattaggaatataatcaacttaaagaaacacaccaaccaggtgcagtggctcatgcctgtaatccaagcactttgggaggccaaggcggtggatcacctgaggtcagaagttcgagaccagcctggccaacatggcgaaaccccgtctctactaaaaatacaagaaaaaaaaaaattatctggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggacgattgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggctttcctgttcttcaaagggcatcagacacgactatcgctcagcatgaaggagatacatagggctaagtgggaagacggcgcaatgcaaaagggcagaggactgaacggggatttgggatgcttgggtgctagccaagaaagactccagaaaacaatcagagggaatctcactttcatttggctttggggctattcttattctctgatgaaagcaccttaacagtacggtgagaagcatgatggagacagttggcgtggcctcgccttcccccaatgcttcgtgcagcaaatgatcactgcatgtacagaaggggatcgaggagtctggagagaaaggacggggcagagagaaaagggggcagtgcctggctcggcgcccagcgtgctgcatgctggtttcaggccccaggaagctggcgggggccttgtcctgagccaggaggagacaggccttggccggtttcctagcaaccctcaccggcagcaggcagtaccccaggcaaggctgtccagggaaaaatgaaaatggccacacgcacagatgcaaaacgaaagcaggcctgcctcccagccgggtgcggaggcaccaggggcccctgccagacagctcccacaccaaactccttggagaaacatctgggggcaccagccatggagggggtctcacttccttctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggtgaggcccccctgtcccagacaaacaaccttccctttggcctctgtcacttgttagttctctatcagctgaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacgaccgtcactcccagcgctctcttcgtacctggctttcttcctttgaaattgccttgtgtgatcaaaaatgaatcataaaacatttgtttcagattgttacatgctgtacagtttttagaacaggatattctattttaggatatctaatcctaaaaactctgggaggcaaacaccttcactttacagctgacgttacagggtctgaggctgatacctgtcagggctggggacagagcagactctccccagcctgcttcctgctctgtccataccaggctcctcagattagagcactaagtccatatatggtaaagctgctagaaggactcgacgaaatgattagtatctaaggcactatactatacatgaaaattacagcaagtatatccacacatacacacacatcagagtatatgtgtatatttttaggtatatgtgtatctatgtatatgttgtgtacataaatagaagctggcatctatctgtctacaacaagaatagaagatatgaacatagggctgggtgcgttggctcatgcctgtaatcctagcactttgggagaccaaggtgggaggatcgatcgctcgagcccaggagtttaacaccagcctgggcaacatggcgaaagcccatctctacaaatgatacaaaaagttagctgggcggggtggtgcatgcctatagttccagctactcgggaggcagaggtgggaggatctgtagagcctaggaggcagaggctgcagtgagctgtgatcacaccactgcactccagcctgggcgacagagtgagacctgtctcagaccagaaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtagtagatgaagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactcaagttcagcagtcaaaatgctataaaacacactgttctttcttcttgttatttatttattaacatcaaggagaggctcacattttgtctttcagagttggttgcaataggttagacctctttgaagccacataaaacaattcactttgtattatgtaactaaaacttaaacgactttagatttgatgacgctatactgctatccctccttgttccctgcaacccagctccctctgttaaacagggcagctctggggcaacaccgcaggcccttcctaggaatagttcaagaaaacagcctctgatttcctacaaggacggtcactgactgtaaaactacaagaggaggtaagaaagtactacagcccaagggttcctcaacccaggctcctgttatacacctgcctttgtgtccacagtgaaaacaacatggaaggaactggttatgggttttgacataagttgtttcaagccagcagatgggatgagatgctgcttccatgacaaagtcaccctggatattctcaggccgaatgagggtgagatggtaccaggcccacagagaggccgcggctgggtgcgcagaactacgacaccagccctaagaagccaacaggctgttgaatgccaagcctgaactattaatttgcatatgacatcaattctgctgtcagtgtgttaatgtgtgattaattctgtcatgggttagagcaaggagaattagttaattgtcagaaacccttctcgttcactctcgtttagcccccgcctccctttaacttccttttttctcttcttattaaactaacctcctgggttttcttcctctgggcacttctgtcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgcggtcaactgccaatgccagtgatacctggatacattgtacaatctgtgctttgtgtgctgtgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggcccctgaatgccaggaaatttcaggaggtacaggcatgtcacaggtcaggctaaatggtccccaaccaccgcagcaatgctgcatacgcacgctgtggggtcaaggacaggtgatcctgatggtcacatttcccaggtttgctaacaggcagcccatacctgtgtccacttaaccccgtcccgtgtctttcccttatcttgagttgcctttcactttgaagcaatgaggaaaaaggaatgaatgaaagcaaatggacccgcacaatcatctacaatagtccagaatttgtctaatttatagggctgggaaaccaagtgtcaccttcgggcctactccttccctgaccaaactgcccagaggggctggaacgggcaccagccaagggtgggcagtgaccatagcttttacgtcctcttgaagacaggaggaaaatgcaaagaggcacagactgctactcccctgtcccccactactcattatataacacatgtcagtttcttgaaagggccctatatttgtgcacgaaagcatgttcccaagagttaacttataattattacaatagagaggaagcaggtaactgagacctattttcacgttacaaacaaaattctgtgatctatttaaaaagcacaggcctccctttttatcttggaagtcactgtttcttttaatttggaaacacatctatcaactgaaacctttaaaaacttaacaaggaataatgttgttatgggtcatgattattctaatgtcttatcattttattttgcatatgcccttatagctaaactcaaactagatgctagaatataattgcccatagtaaccaactaaacagttcccctaagcaatgtgtatttttgcgtctctgtctctctcacactctcactctatcctgcccgcccactcgctccccttcccaagtaacaaaagccagataaatccatggaagaggtgaaagagctacagcgactccactttccaaacacttgtgtgtattacaactctttaaaaatgaattacagaatccactttgaaaaacatattcgggcccttgtggaagttaccagtcctttctcaaatgagctggaagtgtctctgatcaacatgaattggggttccttcttccttttcggagtatggatactaattgttttaatatgggcattattcgcacatgaaactagaattgctcagcacgtgggagataggtcccgaccacccatgggcatcaaagatcccatgacatttctgtaaatcagccaaattccaacacagacagcaggcccagcagttgctgtattcagatgaggggcgattacatgctcctgcctctcctacacaaagcagagaccaatgtttctactcctggcccgttctctgggtctatcctggccaacctcctctgggcacagcccatcagacctccagatggctagttctctctagaccactgacatcctacacacaaaggattaccaagaagccagctcccccaggtttacgaaatttataggaaagtctccaatcaagaggtcaggagacagagaacagggtgttaggaaccatgagctggaggagagtcccagcataggggcttctcagctgttctcacttgaaattacctctaaaaatctatttccatatttcttccctggaatttcacttttagaatttgaacattcagaaccttcaggtctccactccttcttcacttggtcagagaatttcacttggtcagtttcacttggtcagacattggttaaaataaaataatttccatttttaaacagtagtaaaaaatttttatttaaatttgtttagacccacaccaatgagtcttctccctgtgtcacagtaatccttcctccttgtcttccttctctctcaatttctcaatacccatcgagtctttccttaacaatcctcccgattcattctcccgctgggatggccaagttcttctgagggcaacacctgctccaggccgtgcccccttggcctcctgatttgccttggaatctggaataagtcagttcttctccaggtgcaggtgatgggggaagtgacatcacacctcacaaaaggaggatttgggggaacgttcagccaccgatgccctcaataaaaatatctcgtgacttggactcaaaggcagtggccttcccagcggcccgcgaggggctgggaggttcccagcatggcactggggctggcagcaggccctccgcacagccccccgcccctccggagccgcccgggggagctgcagcagcctctctgcgccaggcacactcccagcattgtgctccctccagcgcgctctcccccaccaaaaaccctgaggcctccggagtgtacactaaccacaagcctttgagtggctcatgtatttacaaactgaggcatgtcgaaatcaaaggggataccacatgacataattcgcattaaaatgtcaacaggctgacaatttatagagtcaatccacggaaggtggggaggactaagactcagtaattgtttaattcctgctgaaacccacggccactgtgcctttggaagctgggatgcgccagaggcctccaggctgcacagtgccccctggggctggcaccgtgccaaggccaggcaacgggtttaaccatttagggtgctcaatgatgtggaggatggggggaggggagggggaggggagagagggagggggaggggagagagggagggggaggggagagagggagggggaggggagagagggagggggaggggagcgagggggagcgaaggggagcgagggggagcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcgcccccaccacaacccctcggcccaagtcttggtttcctggctgttctctggcagcacccggctcaccaaggcaccctaaggaggggtcagcggtgtttatgataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaatcccagtagggaggatggcttgaggtcatgagttcaagaccaacctgggcaacacagcaagaccccatctctaccataaaataaaaagtttagctgggtgtggtggtatgtgcctgtagtcccagctgctcaggaggctgaggcaggaggatggcctgagcccaggaggttgaggctgcagtgagctaaaattgcaccactgcactccaggctggacaacagaatgaggcttggctgggtgcgggagctcatgcctataaccccagcactttgggaggccaaggtgggcagatcactaaaagtcaggagttcaagaacagtcaggccaacagggagacactccatctctactgaaaatacaaaaatcagctgggtgtggtggcacacacctgtaatcccagctactcaggaggctgaggcagaaaaatttcttgaacctgggaagtggaggttgcagtgagccgagatggcgccactgcactccagcctgggcgacagagccgccagaccctgtctaaaaaaaaaaaaaaaaaagagtgaggtaaaaaatcaaattcttactgcttaactccacctggatttttgatattggttctacctatatgttaaattaactgacccttgcttggggagaggtccacccgggggtgagggactggtgaaagggatgcaaaagctaagtttgaaaaagctctgggggtgaagtgtttgatcagctccctcaaatgcaccccaagctctaagccaagtttaatcttttcatcattacatgagaacgatatgtctagagaacacaaatggtagaaataagactatttggcaaagcttacaggtcatcatcaggatctgcattcctcagccaggaaaaactgtgttctgaaaggtggcctcgccctgtggctcttgccccagaggatgcctggggccacgcgggctgcgacagggccctccacgcaagctggctgtacataaacagtaacacctcattctctcttctacctcattaaccgaaacacattaaaacaagtgtgcactgggagcagaaaatgagactgttaaaccaagctgacataatcctcatcagctgtgggaaaggagaccgcatcaattatgctgaaccgaatgcagtcacatggatgtgctgggctcccagccccccagcatgaaaaggaggacaagaggaaaagaaacgttcacttaaaaaagaaaacaggctgggcgcggtggctcacgcctgtaatcccagcactttgggaggccgaagtgggcggatcactggaggtcaggagttcaacaccagcctggccaacatggtgaaactccgtctccactgaaattacaaaaattagccaggcgtggtggcgggcgcctgtaatcccagctacttgggaggctgaggcaggagaatcacttgaacacgggaggtggaggttgcagtgagctgagatcttgccactgtactccagcttgtgtgacaagagtgaaactcagtctcaatagataaataaataaaataaaataaaataatatacttcatactctcctaacaaacacagcttctcgcccatttttgtcaccccaagggaggggagcggcatctgatcaaaacacccctttatggttcttctgcacctaaaaatctttgccaaactatttggaattggaggggaaaaaagaaaaataaacataagcttaaaaaaaaaagaggacgggcgataaggagataatggattctgtgtgatctcttgcagacagattttataagtgcaaagtatctcgaggcccaaagtcctaagacccgaaatgatctgaacacaacccgcttgtgacataatggcaaggatgcttcagaaattaaagggctatggagcagacaatagcaattgaaagctacacagctataaaacacagccagcacttagctctttcagccactgccaatagtgaataacagatcagaactgatacatttagaaatactcataaaacctactacggaagaaaacaaaaataatgcctgtacattgccaaaataaggaagattacggttctggtaagaataaatgaccaaatcattacctacacgtaagaaatgcaaaagacttgtatatgacagtcataaaatgtaaaatgtggtacaaggtgccatcactgagccgtaccccacatcctggacgttacaatatcatatttgatagtaataactaactcacgtgaaatgagtattgctatgcaaaactttcttttgcatttcttcatttgtgttcaaatttgcaaccttaacatgtttattgccactgatttgcatttcatttcataggtgaaagtttccaaacataagctgtggacttatttcttatacacctcttgacaccagcatgaaacgtatgttgccaaaactcagtcctcctagtacccattcaattcaccattcacattacaaagagctgctctgtttttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacacacacacacactcttcagctttcaaaagaggtcgggggaagggagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgtggttttcgatacaaatgaactcacttatgcaacgagggtatgtgagctttgcaacaccagctaacactcacttgcgtccagaagctgttcccccttttacgatattctgtggtattgccaaggttacaaaatgtaaacagatacaaacacgaaccataacaagaaccaaagtcaaatatattctcgtttttccatctttgtcctctaagctgtgtatttctagattgtggctttatttttttagagtgaatatgcactagctttaatcagaaaaatatacatgtaagggaatgaaaactaccaaggagtatagttcccctgagtgtcctgtgtactctatgccagtttccaagcctacgttctaacttgcatctaattttggtcacataagggaaatacatgtgtgttgatgcttgcaggaagtcctatttaaaaagaaacaaacaaatactgaaacctcccaggttatgtgggacaatatgataaaattatgtcagtgaaggtaacatcatttccttctcacaacggatgatgtcttaggtacttctcagggaaggggtggagcaagccatagccacaatgcagctggacttgaatcactttctaattttcctgagtacttcactagatcactttttgctccattacttaggagaggagatggagatatccctttgggaaaaaaaaaaagtcctacaaacacacacttagtgcttgaaggagacttagtgaggaatccaagctccacctccttcagatgaggccactacagattggccaaggttaaattactggctcaaggtcatttcactaaacatcggtcataatctctcttcagggaaattccatctccctgctccgcaccaaaaaaaaaaaaaaaaaaaaaatccactgacctttccattctccaaaccaacagcgtgtcaagttcaaagctaattaaaaccaaattataaaaataacgtcagttgtgtggtctaagaagacgatgggaaatctaatgcagaaaagcagagtccttaacacctttctgatgctatatgcagactgcgtctaggtgcatttcatgtattatctcatttaagtcattcgagagtcctatcaaagcaagtcattctattagcccattttacagatgatgaacaaacaggaattaagtcccaggagctgggattcaaacccaggcagcctgacaccaggcatcttctccctccttaaaaccccaagagctatctgggtttcctttaagacgcatggacatcctatcttaaatttttctagtctgcagcacccactgagccccactccacctgccacaccaacatgtgcccggcatctcgtgggcatccagacacctcctgaatggtcagatcccattagatttccatggcctctcccgcagtagcttgagcgctcttaaccaggtatgttactacctctagtgaaatgtatgccctcgtctgcaaaaacagaaataaccaatctgagccctgtcttcagagacacaacagatcatcattactactctcccagaggagtaggaaggtggaggggaggacagcagggattgagaagagacctcgaagcttctacacagtggagccgagagaggagagaacatttcaccattaggttttagtattttaccctcacattgcattatgaacatctccaaccaaggagatgagttgaaaaaaaaatcatacagtagacacttaagtatccaccacccagctgctgaaattaatgctttgctgtctattttacagccttctctttatcctgctatcaatgtgccttacatcttttattcattccaaagtaaactgcagaagcagtacactccacccctccccctactccagcatgcacagcctcaactacagttttctttttgtttatgggtttttattgtagttttattattttaatagatcacgtgagcagacttcctgactagcaaaacactaaaaagacccaaactccagtgtgttgttattatgaaatgtttagctcacaactttctttttttttttttttttttttttgagacagagtctcgctctgtcgcccaggctgtagtgcagtgtcgcgatctcggctcactgcaagctctgcctcccgggttcatgccattctcccacctcagcctcccgagtagctgggactgcaggtgccctccaccacgcccagctaattttttgtatttttagtagagatggggtttcaccgtgttagccaggatggcctccatctcctgacctggtgatccacctatctcagcctcccaaagtgctaggattacagaggttagccaccacgcccggccacagctttcttttaaaagttagagtaggctaggcgtgatggctcagcctgtaattccaatactttaggaggctgaggcaggaggatcacttgaggtcaggagttcgagaccagcctggccaacatggtaaaaccccgtgtctgttaaaaatacaaaaaaagttagccgggcctggtggcgggcgcctgtaatcccagctacttgggaggctgaggcaggagaatcacttgaacccgggaggcgaagcttgcactgagctgagatcacaccattgcattcctgcctgggtgacaaggcgagactctctcaaaaaaataaaacagagtagtatccacaagtatgtgagaagaagttccagttattaaaattattttagtaccatagccacaggttcagtaagtacaagaatgaatctgcctttgtcctctgtctagttcacctttctatatgattctaccctctttaaatcttgctcaaactccagcttgcccctccctcccagaggtctttttggatctaaccagttgggtgtggctgctccctcccttcaccttcataactcttgtgtccgcatttgacggctcttactgaatgatcaattcctctttgtattacgtatcacagtaatacagtttcttaaactgtggatcatgacccattagtgcagtggttctcaaactgcagccgcacatcagaatccgacagtaaatgaaaccacaacctctgggggtcaagccaggcaggcgtagttttttaaaggcccctgggctaagagtcgctggattacgaaatcaggatcatgtcaggggatcatgaaatccatgctgtgagtacaaccagcatttgtaaaacaaaacagaattgaatgtaatagaaagcatcagaatgtagcacctgcagtaaggataaaatcattctgcacaatttctgttttagtcaaatatacagaatatctagctatatgtatgtgctgggtcactcatgtaaaatgcatttctttttagattatcgtcaacaaagtttaaaagtcactgccctaaagaagcaaggacgttatcctgcgcatagcgggtgctcaaggacgtgtggcttgtacatgggacaggaggagagaagcaggtcagagcttctctcactgggaatatgttctgccaccaaaaatgtggttctcagggcgggggacaatcagatatgggactaagtaagcatcattcagacaaagacgctcgcccaaggataagggaacgaaagcaggagaggagcctctagggaaactgagggaggaggcgactcggggctgcccctaatctttaaatttctatgtttaagattccgtcttttggccgggtgcggtagctcacacctgtaatcccagcattttgggaggcagaggcaggcggatcgcccgaggtcaggagttcgagaccagactgggcaacttggtgaaaccccatcactactaaaaatacaaacattagctgggcatggtggcatgtgcctgtagtcccagctactcggaaggctgagaatcgcttgaactcgggaggggggggttgcagtgagctgagatcacgccactgcactccagcctgggcgacagagtgacactctgtcttaaaaaaaaaaaaaaaatccatcttttgccatcaaatcatcaggcgacacttgctgatagtctacctaatatccccaagaccctgggaaggctacaaagttgggtgagaataaacagatcccaccggtaaggatcttacaactaagcagagaagaaagaccactaaaaatatggtctatcataagaatgggaaaggaacaaggcattttgatgagagtgctggggagaaagagcagtgattttagttggcagaatttgggcggacagagccgaaactcacgggtggccagcagcacgtgggaattttcaaagtaatttgacaccagctgcatgatcttgccagggctgtgtctcaggggtcagtacaggaacagagctgtgtgtgaagctgatggtaaatgacctgggctgcagaagctctgcaatgacctggtccacacaagccatccactttacaccaacatatgccttagggctctaccttatgaaatgccaagtgtgcgcatgaggctgttgtacctgttctagcacagggcagaagcacggcatgctctgctggtaccctatggttcaatatttattgagctggtgtcacacactgttctaagcattagggacagagctgttaatggggcaacgtaggtctctgctgtcttggcagacaactaaattaatgaacagacaagaaaaataaatataatcactgtcaatgcagagaagttatcttgagtgaagtgatggtgtagctccttgagactgggttgtcagggaaagcctctttgacgaccagatattgaatgagagctgaatgtcaaggtcaaggaggtacatacactcagtagaacagcaagtgcaaaggccctgtggcaggcgccagcttagcatgttgaatgaacagagaaggctgctgtggctgcagtgtagggggcaaaggggagagggttgtaaaatgaggtcagcatggtgggaggagttcagatcacaaaggagcttgtaagccacagtacaaaggtgagcttttatcttaagtgaggtggaaagcctttgtggggtctttgcaagagagtgatatgacctgattttcctcttcgtaaaatccctgtatggagaggggattgtaaagggcaagagtagaggcgggggagagttgaaatacagagagacgatgggggctggcctgggagggtggtggtgcaaatgtatttttgaaggaagcacccacagaacttgctgatggtttggctgtaggggagcaaaagacaaggagccccacagatagttcccagctttttgggttaagcaaatgatatgctggaggtggccctaaccgagatgggggagcccataagcatttgggggttctggtcacagagtcctttctgcaccatgctaagcctgcggagttcattctcagacattcgaatgcaaatgccaggtggggagctggatacaggaagaggcctaggctagggacagattcagatgtcatcagaaagtagatggggtttaaaaccactggactgaatgagatacttagggagagttacagacagaaaaaagaaggggctctgggacaagcctgggggcataataacactcatcgtgaagtcacagaagagaagccaacagagatagacaaagggcaagagtggcaaaggcggctgaaaggtccggcgaattaggacacagccgacagagtcagcaacacagaaaccactggcgacctgtcctactagtggtgaaaagtgtcacttctggatccagcaactgggaggggacatggtgagtcaactcccagagtgggcatgattcagagtgaggggttgctgggcaatgcggccttgggccttgggtgccagcccccatggaggaccaggtgacttccatgagtacaggctgccagcttcagggccaccgccatgctacaccccgcagctgctcccacgccacctgcagaaggcagtacctttccatcctctctgttccacttctaccactgcagagggaaggaaggaaaacaccatctcctctcacttcctgaccttcctcctctgcctccaagagcctttttttggtttgtttgtcctatgcacgactttttcagttttccaacaatcactggtgtcctatacttcttaaccctccacttgtaaaacaacacctttcagacactcctcagctacttttcttgcaaagaaacttgctgtcagtaaagacaagagagtaaatggagagaaacggataaccacctgctgatgtctacttgtgctgcattcttgagaaactcacaaaactgaaggcaatccaggtcctcaagaggtttacgaaccagttggtgaaaccacctagcacatgacgcagagaccagcgtggtgccaaacagtgtgacacccgtgtggggcagagatgccgtgtgtgggtacagcagctggagagacagttctggaaaaccagggatatgtcactagagcataaaagatggacaggaaatatgctcttccttaaagtctgattaaaaaataaaagatactttccaacagggccccgtgcccatctcagcaacgcagggcgtgtgtaaccaaatcacacagaaatgagcacttaaaatgacatctgttggattaattagctgtgtaattagtctcccctcagcggagctgggctttgtggctgttgtctgaaatctccccaggtgacttgattccaaatgccacactccaagaggaagaaagcacaggccaggaaaagaagacaggcgtccgaatgtgtttgcgggaggcagcgggaagggagagggagtttctggagaatttggtgggtccctcgggaagctagctagaacatcagggaggaatagccatccacagaggtgtcactcgagaactcaccacctcagagcaaatcggcacgcccccaaggcatgagttttggataaccccaaagcactaaacactcagagacatgaattagggcggcaagaccctggaggtgaagagagccgagtatggattccgagttggacacaaagagacgggacagaggtcagagctcttgtccctggaggagttgtttggtcttcctccgctgacagctgcagccatcactaatgtgaacccagtctgggcaaaaaaaaattaataatgaaaatggtcagagcctaatctgagaaccagaaagtgaacaaccacgcacaaacagaagtctccagccaaatcactccccacagtgcttcctcaagcacagctggcttcggagtcacacttgctgactcatgtctaggacacatagccctgggacccgcgccacttggcctggctcactagaggagccgaggaatattccccatgcttctctatctataattattttagaaaacaagagacatggcggtagaggggaagtatagaagacaaaggcacaggagctatgggaggaccacagtgaaaaccatcttggagcaggggactcctcagctggggacgagccagtggggttacctttgatctcccccacccccatctcgaggcacagagtaccctccacagagcaaaaacatccgatgctgctcagagaaccttcctgggcctgcgacaatgagcagttcgtaaagaatctggaacatgaaacattcaaatcaaacaagccctgttcgaaaccagcaagacatgttctaaagctagatggagccactctgctaagacactccctgccataaacacaatcggagctcctcccagatcttcagtagcgccaacaggcatctgcaggaccactgcagtgacacagactcgctcccaagggcaaaaggggtctgggagcaaacaccaaaccccgacattatcattctcattgtcccgaaggcccatagatacaggctgggtgcagtggctcaggcctgtaatcccagcactttgggaggcccaagtgggcggatcacttgaggtcaggagttcgagaccagcctggccaacacggtgaaaccctgtctctactaaaaacacaaaaattagccgggtatggtggcaggcgcctgtaatcccagctacttgggaggctgaggcaggagaatcacttgaacccgggaggcagaggttgtgtgcagtgctgtgatcatggctcactgcagccttgacctcctcggctcaagcaatcctcccaccgcagccctctcatgtagctgggactataagcaccaccacaccctgataatttttttattttttgtagagatgaggtctggctatgttgcccaggctggtcttgaactctcaggctcagctgatcctcccacctcagtccccactgcagctaggaccagaggtgtgtgccgccacacctggctaattttttaaatttttttatagagacagggtctgtttatgttgcccaggctggtcttgaactcccgggctcaagtggttctcctgcctcagcctccctgtgttgagtttacaggtgtgagccatggccccaaacaagttttttagtaacacattacacattcgtgagcctgagtctgtacaaaatcctacttcaatggccagcacaaaatcagtactccacaaatgttgttgacccagggaacgaagaccccttcccagtgatttcagtctcccagaagctgcacagggaaatctgggaaatcctgtgcctcttgggtcctgagggctggggtctgaacccatgggaggagaagaagtcagggtagccaatgcaaggatgccttccacccagaacccagacttctgtctcattctgaggggcagcaggaagacacggatgccccggtgtgacacgtgccaccaagaaaactccacagaggtcagctcagaaggggttagaaaggtccagtcatcctccaggaagagcatactgccagcgacagaagacaggaagagagactcaaaaggaacagcaggtgggtgtaaaccccttcagcaaccccagtgcacaggccggccctgccaaggcaatgtgggtatcactgttgacctaagagactggctatgctttggaggctctcatcctgagtccgggaacatgctccactcattaacaggttacaaaccaaacactatcagtagataaacatttctaaccttctaactagtttgccttttacagaaccaggagggggaccctagagaacatctcctaatcattcttgatgattagtcccaatttaaacctactctctgcattccctattagcgacctatacaccataggcacacagggtctcccacgcactgtgagcaatgctcacgtgctgtgaattttcatggtctacatataagtaaccagtgcaggaggagaccaagaaggcctggagtgaaccaggggcagcttcaacatctggccaagttgctggtgaccgaaccaggcctcctgatgtccactgtgtgacgcaaaggcatttcaataaaagggactcatgaaaaaaatgactgaaaagtaagtttgaacaaacagctctagagaaaatttcagatttctttataggaaagcattttacttaacacacaaaatgtgaatattggataggacacttttctataaataacaaaaactggatatcatcattagaggcatttgtaaatttcttttgttgggaaccactggaagaaaacgggtttcacaaacaaggaagccacatagctctctttacacttctatagagcctgctggcaggtcattatgaacaaatttctaggctatccagaggtagagctgctaaacaaaacacgggatgcccagttaaatgtgaatttcaggtaagtgtaagtataatttatgagatacacttacacaaaacatcattgttgcttatctgaaatttacgtttggaggccaaggtaggaggaccacttgagcccaggagtttgagaccagcctgggcaacatagtgagaccctgtttctatttttttttaatgtcatataaatttctttttatacaaagaaaaagaatgaaattcacatcactgagaattccacagttttctttgctgtatttgccaacaccatcccaagtcaccaccctaatgttgctagtttctacagtcgccagtatttctatgagtgacagattttctgccattagaaaattttaactttcattctacatcccggctgctgtaagtgctaaaaatcaatttctgttaagtattaaatatatacttactcaatactaccgaaatggttttcatagtaacagcctttcccaccctacacttactagtatttacagtttcaactgatgtgtaaaacagaataaagtacatggttcaggtggatcatataattatttaaaaactcttgccttttcctgactatgttcctgacaatgcctaattgttcccttatgatttccctttcaaaacaaaaaaaccagaaacacctgttgggactagacgtattcaaatctgccctttgagtccaagtcctcagcaagttgaaagaattcaacattgagttcacacctttgccccattatgtggcacctgccatattggctttcctgccagagtgtgtttacctaaaacaaccgtaacacaacgcattatcctggaatgcagaagcaacggaatatttgcacaaaattctcctaagggttacagaccacccctaagacggcagatgtcatttatgcgaagaattccacggtgtgacttattcctctggatgggtggggggtaggtgaaggtactggaagtttgaggtttctctctcataagaaggtccagggctttctaaatagagaatcggggggattcgtaaatattttgacaaagtggtagctattagactttctgaaattagacctccttgctgctcagcctaagtcaggggccatggtatacctttggaatccaaaaggagacttgtaaccagtacctgaaaacagtttatactggaaatatgtcgacagagtcatgaaatttatatgctatttacgtaagaacttcaggaaagggaatttccatggctttcagaatttgttcctgaccccttttttaagataaatggtgagatccacagtctccattaaggtgccctaaaaacccagctcctctttgcagactctgtttcttctggaaactctctcatcctggagagttcaatgaaggcaaactaatctaagaaattttcttttggggaacatgccagagagaaataggaaaaggtgagaggaaggcgtttggtccacagactccaaatgccaggaaagagagccaggcctttccatcccttcttcttgttccccagtgtctccgaagacagtattccgtaaatatgttctgatttacctaaatctgtggatcattcacaagaggttctgcaagacgtaagagaatggagaatgagaaacagcttttcacaccagctaggaaaggctggttatttaagcaatcgttgtacagctagccattgaatttgaaggaaaataaagagtcctaaatcacactgcatagtcttacaactatacaaaaaatatattcctgaaaagtcacaaatagggccaggcgtgggggctcacacctgtaatctcggcactctaggaggccaaggtgggtggatcacccaagttcaggagtttgagaccagcctggccaccatggcaaaaccccatctctactaaaagtacaaaaattagcgggtgtggtagtgggcacctgtaattccagctactcaggagggtgaggcatgagaatcacttgaacccagaggcggaggttgcaatgagctgagatcacgccactgcactccagcctgggtgacagagtgagacccagtctcaaaaaaacagaaaacaaaaacaaaaaactgcatgacaaaaaatgttcccccatctacattagaacaatgaaaagggacttactttagaacaatgttgtcaatctgacaatgaaaatggaaaaacaacaacacggtgttggtcactgtgtgggagtctggccgtcacttactggggaaggatgacatggccacctgctttctgaaaggccactgggaagtgctgcatctactggcattaggtcctgggacccaacaaccccacttcatggtgtgtgtagagaatcatgttcctagctcattatctgcagtatccaaaccctgcacataacctcaaggtacatcaaaaaggagctggttaataaaggaaatactatgtcgacattaaaaagagtatctacatgtactgacctaaaatgattttcataaaaagtatctatatgtactgacctaaaagtatctatatctactgacctaaaagattttcctgaataaaacaaactgacactttgggaggccgaggtgggtggatcgtgcttgagcccaggggttcaagaccagcctaggcaaaatgtcgaaatcctgtctctatgaagaatacaaaaaattagctgggtgtggtggtgtgcacctgtggtcccagcaacttgggaggctgaggtgggagaatcacttgagcctgggaggcagacgttgcagccagccgagatcacgccactgcactcccatgtgagcgacagagtgagaccctgtctcaaaaaacaaaataaagcaaaattgaaaccacagcatgtgtctataaagatttttaaaaatgaacagtatgtgtgtgtgtacagatacatacacacatgcattttcatctacagaagcacagaaaagagcacaaaatatcaactacatgtaacagtgggtttgcctctggacagtaaagtcagaaagtagacaaaagacatccactttaaaaatcattggaaaatacttaaagatgtaaaaaaggtctcaggtattacacaacgtcattccaattttgtaaaattcctatgttacatgcaaaaataaaaatccatcacatggtaggattaaccagatatatttactttcttttttattcctggatttttccaaatttttttacagtgaacatgcattactcatattactttaactgtaaaaaatagggaatccacattttattactagcttacacttgaggtaaacatggaatgctaaccttttaagaaataattaagaatacaatactattctaaaagggtctggtcagttctttactatccacaaaaaggactcagaaaagagagagagaaaaaaaacactaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggacgaatgtggatgaagataggtgggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccacggaaatgaaccgcaggcctccagctgctccaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagccaagctgggaaggcaggacgggagggaggaaggggacggtccccaaaggatgtatgctttttgctctcagtgcaagacaaaggcctccaggcaccacctacggacgtaaaatgtgtagctatcttcctaagacccccacttccccccagcacacccacagaggagcaccaagaatgcagatttcaaaccagatcattgtctgacttcacctacattttctgatttgcccgtctaccatacgatgattttatagccctgctgggagtgtgaatcccaatgagtttcttatgcatcagggaaagaactgaaaagatgggttctaaagcaatgcaaagtctgatggaagttttcttacattcttccgtactgcacaatcctcctagaatggcaggagcagacatcctctatgtggagaatctggccatgtgcatgaatcaataccacactctgcctcctacctcaggccaagcagagttggcttggacactggcttctcctctcctgtgtgccctgttggcccacagcagctcacatgtggcccagactcaacaccgtggtagacaaccctccttgtacagtatttaagattaacaggtaaccttcagtcttggtccaatcaaaggaaccccagctagaaaccgttttgagtaacagattctggtagggtcttaatctatctgctaaagttgacagatttccactccaatgactctcaggtgaagaaaaacatcaaagtgaaaaacagattctgggagatggtgggagtgtgcactgatttccaactgccctttctgtgccccgccccctccgggtagaaagcagcacacatttcagagagctcaccatggacgtcacttggctgggaatgcaagataaacgtggaagagctggtgccagctctgaacccacacgcctcagacgcaggctgtacactagccgtgggagagggcagagggcaagcatgtgtcagtgacagccgctctcctagttctgaggatcaagggcacccacatctctacgggtggagaagattgagagtggggccagggtgtagtcctctgagaaaggagtgatacatttacatgtgaaagcagaaggatgaggaattaaggaccccggagctcagtcccagttgagagacaagtgccttctgcatttttccatgctggctcagatgtgacactaaggacagaaagagcccagttcccaagcttcactggagcctctgggcttcttgctatgtcagccaatcacggggatcccaagacggtaaatgttaggacgtggacatgtgagcattaggggctaggccagagccggccactgtttcaacccaaaagatcccaaggatttcaatcaggagcactttgcagaagtaacctgaggcccagagacaaggtaagggggcttcccccggatgcctcgggccctgcggcattcccctactccactctacttccaggaggtgcaaaagaaaaacaggttgaacctaatcctgatttaaacattagtatcacacaaaaatcaaaacgacaccattccaggcaacgaagacaatatcatcaggttttgtagattagcacaaccctctctcatttctggattaaaaattatctcacgctttcagaaagttcactcttacagcaatctacgcactagcatgcgtgacagcaagggcagtgactccggcccagggtgaggtcagatgacacaccgaaagccatgccactgcttgaatctcctgagaatgcagctctgtctcctccaacatgaaaaaggaacaggaggagaataaaagcctcggctgaaagagaggtctgggagggccaccgggaagccacatacatcactgccacttcactaggtgccgcggagagcagctttggagagccgccctggctgatcatgaataatttgccagggaaccgggacagggtggggtggggaaggggtgaggaaggagggttgtgtgtgagaagcccggtcagctccccgggtcagctgcatctggagcggtttctctagcagacagtaaagaactcgattacatccagttaactgtgctctaaactgattatgcatgtgccgggctaatggattacattagcaagaggaaaaataacatgcaatcaatctccatttactacaggccacaccagggcctagagaaaaagtgactctcaaaccacctccaatccccaccccaaatccgtggaatgacgaaaccttgagagggagccttccttagtggcaagagaagtttgatcttagtcgtactgagggaccaaagggctgagggcgagcactggaatgacaatcccagcggtgtcatccaggagtgagcgggagagctccccgccccctgtggcgaagcccgggcaggcacagggccattcattacccaaggactaatgagactagactaatgacctttggctcctgacggaggcaattctgccctgaacctcaggctggtcactccggggatgtgccggccagatgcaccatttcaggatctctccttcaggtgctgggtccacgttctaccctgcatcccaacgctcaggacccttctacccacgccatctttttgagcaacagtttcctctaccttaaaaaaagaaatgagaaaaaagtcccaggatgacaggccagcagtgcagaaacatgcaaataaacctcgtctcttccaaccacacctcaccctgactctctgggtgtgatccgtggacacagtttggggaccaaaacaggatgttctcagcaaatccgccgagttccaggcccgtaagaagcaaagtcaagtgcctgacagactcttattcaagactccagccgcacggaggatgcagcatgagagttaatcgccaccgtgtgcattttagagtctaaagggcaattttttccttggatgcaagaggccagcttcatgccacctctaaacgaccttcatcaaagttgcatgcaaccttcaatggccacgccgagtcctttgtacaaattttactcagttgggtcctttggaaattcttttttccactggtttttccatcaggttttcttgaccacgtcggcaccatcctgtggccagttcagacctccaatttaaactgactgcaaagggcttttttcttttaatggtggcaaaactaagccagtccagcaaggttcttgctcatttgagataaggggattggatgcgtggtgtccagaccttcctcactgcaccatagctgagtccacagtcagttccagaacattctatcccctctacctcattcctgctttctcctcctttccctaaagtgctttcttaagcactacgttatgcaggcctccccacatcctgagaaggaacaactataaaatgaagtacaattatcaaccccggcagaggccgacatgggcaaaggactagaagtcttccttatatggaatctccgtttaaaatcattctgagtagagtagggactcaactagctcggggccagcagaaaccaaacactcgtgggcccaaagacgcgagaaacagtgtgaaaggcaggaggagaggctgataatgggagtgaggaaaatgaaaagagagagcgagggagtggaaggtgtgtgggatcaggccagggagatttatggcgatttgtacctgattgttcatactaaagccattatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaaaggagaaatagaaaaaaaaaaaaaggaataaagagatggaaaaggagaacagaaagcctaaaggagagagggaaaccacaggagcagaggatgcaaaagagcccatgtaagaaagaaaagaaccaaccctagaggcgctgtcaacaaaacctgacccaaaattgggcacccagaaagagaaccttcagctagtcaagctactcactgaacctgtcacgtttccacctggtgacaaagtggacaccgccgactctcctctcaactccaggttcccaaccaacagccaagcaggccatgccagagactgtccgactcctccccagtgctccctaactccccggtgcgcaaccccctcctttcagaaagagcgcctgagccataaggagctgggccttaccttgtacaacttcaggctggcctcgtgcctggagttgaccgtgtgcagccgcagcttctccaggctgttggtgtagtagtcacaggcgttgcacttgaggtgcacggggttgccgatggccacacacttgagcctccactcgttggccttgccgccctccttgatgtgggccaccagctggtacttctgcacgtgcttgtctgtcttgcagtgcagctggaagttggccttgagctgggtgttgtagcggcagagcttgcactggtatgagtcccccatcaccgccttccactcgtcctccgacaggctgcgctccacgttcatgtgcaggcccagcatgtccaggttgtccgtcgtgaacttgttgcagacggcgcactggaagagcttcagcgacgggtcgttggtctggatgaagctctcgcccaggttcatcagctcctctgacaccagctgcccgcccccgagccgcatgtctagggggatctcaccgcccactgcagggaaggagagaaggagagagtcagacaccaggctcatggtcacggccacagctgaggcaccccccagccctccgccaccctcaactggggtccaaaaggagaagatgacatttcaagtgttgcaaagggctactggctggaaaacaagcaaacaaacaaacacagtcaacctgatgtgtttcaatctttcctgcggacattctgagatttctggcaggttttgtattttctttctttaggaaaagaacacctagaaaagttaggagccatagcctctttaatatttccttttctttttttttttcccgagatggagtcttgccctgttgcccaggctagagtgcagtggcacaatctcagctcacggcaacctctgcctcccgggttcaagcgattctcctgcctcagcctcccaagtagctgggattacaggcacccaccaccacggccagctaatttttgtcttttttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtcacagctgcaatcgtaacataccaagccttcatggggaaccagaattgggcccagaatgtatctgaggtggcagtgaccaacatgactttctgccaccttgagaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtggtgtctcacacccctaatccaagcactttaggaggccaaggcaggcagatcacctgagcttaggagctcaagaccagtctgagcaacatggtgtacaaaatatacaaaagaaactagccaggcatggtggcgtgtgcctgtagttccagtactcagggactgagatggaaggatggcttgagcctgagaggcagaggctgcagtgagctgagaccatgccactcagctcagccctggtgacagagcaggaccctgtctcaaaaacaaaacaaaacaaaaaaagacttggagagtaatccctctactcctcactgctgccctctggtcaatatccctcccgtcagtcaatgctgccaaccctcccatgtcttctcagtagggctacctgttctctttcctgatcctctgccctgggtgacatgtggggctaccctaggaccaatcaccttccctttatcactcagtcacctacctacagagatgcaccatagctgggatccccatcagggcaccacctccctaggacaggggtccagtcttatcctcgctggccctctacagagtgcacagacgcccaaatgtttgctgtgccagacaagagtgaaaaaagagcgggactgctgcacgttcaggaagtggattgagacaggcagtgagacacgaggctcagctccacgtctccacgaaagggccgggcgaagatctcttcctccctctcccaccctggtctttttcagtccatcactgccctgcataaaccgggtacaagctcacatttgctatggtaaattaatactgcaagggcttatttctaccaggagaatggcttaaaaagagcagccttccctccagttcctagaagcgtacggtcaagcagaaggctgggcactggcgtctagtttctctttcctaaacacacgtgcacttgagctattaggtctgccccaccccccaagtgaaatttaaacttgaccttttatgtgtggttgggctgaggttattttattttttacaactgattagaatccaagtcagtggctcatcagagaaaatatttttttcttttttttatgattttcttattgacgctacacaagtcacctcgagtgataagatcagtacaggttctgctaagcagaccagcagctgcgtttgaagctcacggacagtctagcaagccacagaaatcttttgcacatgcattccagaaggcttaggaagctttcggcttgttgtctgtcttcccatctcccctggtgagaggaaccataactatgtcattctttttaggataagaaagaaaaacagaaaggaaaaagaaaaaaaaaaaagcctaaaagctccatcccttaacggggacgaaggccaggcaacatccaggaaacatactcagtgttcagtcaaagcagaaactgcccggagggtaagacaaggagcaaacatatatttgtttctgatgccaaccacctgaagcatcaaatcgtctccactttttagatttcaccccggcacatcaacatcgctctaaagagaaattcagctgtcacttgctgatgcctgagtgaaaatgagaagtccttggaataagcagaggaacgaagtcccagtttccactttaagctctttttttttcaagagacaaggtctcattctgttgcccaggctggagtgggtcactgcagtctgggccaccaaggctcaagtgaaccacctgcctcagcctcccaagtagctgggactacaggtgcaccccactacgtctggctgatcttaaaacaaaaatgttttgtcgagatgttgcccagactggtctcaaactcccaggttcaagtgatccttggactcccacagtgttgggattacaggcatgagccaccatgcctggccagcattctaggctgttaaaatgaaatgcaaaggacagaagcagcagagtgctgaaatgagtgaggatgacaggcaagtgaaaactcccttcgagaactatgcctcagagaaacaagcccagggcttagaatcctacaaatccgctaatccagctgccacaaagtgggggaatctcacccagttcacaaacaggagcagggcccctataaataagaaactggggctgggcatagtggctcacacctgtcatcccagcactttgggaggccaaggtgggcagatcacctgaggtcaggagttcaagaccagcctggccaatgtggtgaaatcctgtctctactgaacacacaaaaattagctaggcatggtggcgcatgcctgtaatcccagctactcggaaggcagaggcagaagaattgcttgaacccgggaggcaggggctgcagtgagccgagactgcgctattgcactccagcctgggcgacaagagtgaaactccatctcaaaaaaaagaaatgaaaaaaagaacttggcaggtccttagtcttgagccacactggatacgtggtcttggagcaggtccccatctctgggtatgcacctaactctaacactggaactgacaccttgacacgtgagcccacccatcagcacatcctcaggaaggtgcatggattcaaaggcacactctggaatgaaagggagacgaagggagctgctaaaccttgtgcaggtgtccaggggctggctggctacttgggaaacacacagccaccccgacaagcaacccctttcttggtgctatgctaaacttcagagtcgaaaggaaggtttgggaggatgttcacaaggcctcaaatctaatgtgctgtctacaaagagcagcagatccgactgtactaggcgaaggagccccaagcctttcctcaaaggcttctgaaaagaagcaaccccacaatcagtgtctgtttgatgatactaaagagggctctgccaagggaagtatgaaaacaatcaccttgtaaagaggagtgtatttcacaaaaacatttttctccctgcagaactcagtcacatctaataacacctacagccatcttataaatggaccatggggaaaaaaaaccagtacagccacagctagaactgaaagttatggctgtttttatttgcataagttggtttctcctactgaggtcatacaactcaaattccaagtcttttggacacttcctatggcccccacacccactcgagcttctggcataaaggatttgtggctctcacaccttctcagcagttttcgcggcccaaggaaggcacaggtttccagggactccccgtggccgacaagtagtgacactggaaattcaagagccctttgtgactgagctggataaatcctttgggaggaagagctccagtctaagaaatatggtgtggcccttccatgtgtgtctacaacacagggcttcattcttctgctccttctgaatctgccgcaatgcccaggacagtgcatgatgccccaaagactcacagacacttggtgtgaaagcgaaatatttctctacttctcaatacaagccttagttacctgttcttaaggtaattaaaaagcctcactttaggctgggcacagtggctcatgcctgtaatcccagcactttgggaggccaaggcgggcagatcacctgaggtcaagggtttgagaccagcctggccaagatggtgaagccccatctctactaaaaacacaaaattagccaggcatggtggcgggtgcctgtaatcccagctacttgggaggctctggcaggagaatcgcttgaacacaggaggtggatgttgcagtgagccgagacggcaccactcactccagcctgggtgacagagcgagactctgtctcaaaaaaaaaaaaaaaaaaaccctcactttgacccaacatgaacctacccacgttcccacgttctgtcttcattccacctccgttatgtttgatttgctccaagatctacctcccgagattctatgactccttctaattcctactggcttaaagaaaaccttagagtactcactcccatctcctggtgtgcatggttcaccctggtgacaaataagacgaccagtgcttgtgcatccacaattagccagttggtttcaaataccctcaaatcatttggtaataaaggatcaacaggcaaatatttcaaaatggaaaatgagattaaagtactaaggattaaaaactgaatacatagcaagaaaaaccaatggaatgctttgaaatataactcatcggcaacaattagcactcaaacaccacacaaataaacacttgccaactgctgaggcctggccctgcagtcatctaagccatcctggaaaaaaagtcctcactgacactctgttgccaagaacaacctattcccatgtcaataatggcatattgcttaattcaggccattgtcactggtcccacgaagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttggtcctattctagatattgtaagccaattggtaagactgggagcctgaacagagccaaatcagcttctctaaagcagaggtcattcttcctggcagcgaaggctccgctaaccaggatctaactgctattaaaagttaactttccttgatggacaatttttacaacttactcatttttcatctctcacacccctcacaacagtgccactggggaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaaatgattgcctcagctacagtttcctgtaagtttcagtaaatattcgatgaaaccccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagagtcaactgaatccacaggactatctcaccctattcaccattctccctggttaaactcctatcatgaaaacagacaaacacgtagtcatcctcacctagagcaggcgtcatggcggccatgggcccggcgggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgcggaggttcctggccacgttggtctcataatcacacacctcgcaccgccaggtgggtttggtttttggtttggtcggcgagggggccccgcaggagctactgatattggctgccgccgccgccgcagccaccgccgccgccgccgccccggcagtgtggctgaagacctgctccccccctccattctgcaggttctgcatgttgttgagatgcttgtcagactgcatatgaatactgaggttgcctttggtagttgtggagtagttacacacctcgcagcggaaaggcttgtaaccacacgtgtagctctcgcctcgtgccagccgggggtggggctgcccgcttttgcagtagacacaggagccccccggctccgggtgcttctccttcatgtgtgcctccagggtctgctggtacttatagtgccagttgcacttggggcacttgagtgtcttacacgagttacgagaatgcatcatggtcatgtggccgcccagcgagcgggaggagcccaggaccgtgtcgcatttggggcactccacgccactccccgaggggcactccccaaccccaagctcgcagagggagccagcgtgctggtgatggggaacgaagcccccatcgtcaccctctgtgctttcatttggttctggtgctgtggcattgtctttattggcactttcgtcagcgaagtccagcctcctgccgccctctgccacattggccctgacgccctcactgttaaagcttaaacgattcctcctgttcgcaccatcaaagacaacaaaggaagaagcagaattagaactagtagaagctgtgcccctcgacagggtctggagcacgttaggcattaagggggagttagaaatgctttggtttgagagagcaaggtcctttttgctgctactacctgctgcggccccaggctcctcatggggcctgtcctccagttcctcatccaactcgcttggaaagagtcctttgcaaccctcgtcttcctcctcctcttcttcctcctcctcttcttcctcctcctcctccgcctcttcctcctcctcttcctcctccgcctcctcttcggctggctctaccttctcagagaagcaatccccgtcgcccacttcctgcttctctccttctgccgccccagagtccttgccctctgaggatttggtaggactggaagccagaggccccagggggactgaggtaatgggggtcttcagtaccgagctggtgagcccgccaaggttcaacagggtgctgggggtcaagagaccagcctggggctgctcggggccagcggcggagcccgctgggagagcttcctccccttccattcgaatgccactaaatttaccataaaaactgtgtccggggcctatgaggttagctgtggaaactaaagggtgttgaaagtttttgttttttggttccagaaaacttacaaggggttccttgtctttgccgatcccttggatgatagcggagatgttcttattgctaagaattttccgctcgtcttcgctcagggtcattcgatggtcatgcaccgcgtgggtcacaaacgaacggacgtacccaaaggagagtttgcacaagaaacacatcaggatgggcttcctcttgccatagagcacaaagccatcgaatttggacaggtccacattgttgggaacatctttggatacgcaggagcttttggcagaaccgtcgctgttcaggtaatccttgttgcttttgtgtcgcacgtcaaacacgcggaagctgtgcaggacggggctgagccccgccagggctgaggtattcgggaaagcctggtctgggccctcaaaccatttcccgaaggatgaggctatgtggaaagtgttgatgatctgcgggtacacgggtgcagcacacgaagggtccccttgcttgccccccgcgccagggagagagttcaggaaaagcgaggggagaggcccactgccactgccactcccacaggcgcccccgccctgggtcagctggctcaggctctccacaatgtacgcggagccgtccggctggtagacgatctccccggccaggttctccacgtcactctcctcgtccccctcctcaccggtgtcgctggcgctctcctctctcaggggtggcggggggcgcgcgctggggcagtggtgctccatgtaggtctggaggctggcaaaggaggccgaacattcgttgcaggtgacctccttgctggcgggctcggaggggggcccggccgacgcggtgctctccgcgaggcgctcattgaagggggccctcaggctgtccaagggcccgtggctctcgcctgtggactgctccatgctactgggtttgtcagggaggtgggtgctgttgagttcagtccattgctggtgctgagggataccgcacccattgtccttccccgagacgacgggcgagtcacagccttccatggtaaggcctgcgtggagctttcattgcacccagtacggaggctcggacctgaagggcagaggcaaggggggaggagggagagaggggaaagagagagagaaaggaaagaggttaggagggccgaggctgaggtcctaccgcacggagcgctctaagaggcttctgtccacaacacagagacacagggcggagggcgggcctggggacactgccccacacggtccagcacacaggggtggcatggccgggtcaacagcctgagcgagggatatggggaaagaaggccaggaacagccctcttcggcttcgaattgtcaccgctctgcccctgaagactagcgggaatttccattctttgccagcatagcttcgatgggccacagtggagaacggacgcgtcatctctccagccctctacgaggtcacagccacagccctaccacttatggacagctcacacgaagtcagccccgactccgcgcactgtctgtgggtcaggggaacacaggggagggctgagaagagggaggttcaatgtccctggaaaaaggacggtaaagtgggataacgctcatggatttagaacaattgcagccgtcgcttttactgaccatggttctagtttgagaagttcaaagaaggcgggtgaggaccctgaggttcacagggcaggtgtacaggactagacacactccgaaaagtcctctccagatctgggaggcgtcagtcccattttacaagcagtaaaacagaggggcttcaatctaaaaactggctcagtgctaatctcaccaccatgaaacagaagaaaagatgggtccccagattcctgtctcctccacccataccagtcaagctccctggcctgtgactctagctgacttcagactaaaactacgtaggtgcaaaacgtgagcttggtatttccagcaggaatggaccagactctggatctgccaacaccccctccagcagcttctatctggccctggctggagggagtgcgttccccacgtgcctggtggtttttgctatcaaggatctgagcagcaagccgagacggcagctgggctcggcgagccccagctccacacctgcctcttagttattagtcgctacccaaccagctgtcgttcagccctggggcttttccatttccgactccaaagtgccactgagctgaatgtgccctctgagacctcatgtccctggggagggaggcatcggatcacggccgctctgctcctgcagtaatatcatcgcaggggcgatcattccgtctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctggatgacatctgattgatagcttgggccaaaaaggttggcaggcctgaaggggcgggagggttaacagcccgattgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttaccaattaattggtgggcttctcttgctccgttctcctcttattcctcctcctcttccacaaactatccagccaagaggctgggacttttaaaacctcccttactttgttttctactccaaagcggaagatgtcaggaaagaatgacactgtacccacctatgatggtggctggtgaccctgtggtggtgacactagagcccacccattcacggggagcagcagccatgaggacacgggtcggagaggaggaacccactgcaggacccaagctacctcccctgggcctcctttccatgcgcaccagctgtgacaaacaggcccgtttgcagccttgccaaacaagcgtggtttgtggacttgaagcattatcctctccggggagcttaagagacatgcactgtctcctcctgccccatcagaatctgcattttcacaccatcctcagggaccatgcattaaacttaagacactctctgcttcactccatcttcaccaatacaggtaccaagcacagctcttctgtccttggtacctgtattgctaggtaaccagggaaggtcagtcttagattccctgtggtccctgggaggtgcagggatggagatggagaagagggggacgcgcgcacagaggtaaagaagtctccccaatccgccacatcctgtggctcaagggtctcagggcatctaccactcccccgcaacagccggctctctctcgctctgtttatcagccagtcaataagaaaaaggtagttcttacttaaggaggcagaagtcaactcggcaggtcgatcagcactctgtctgtaaacacggtttcccgtaaaatcaatgatcttcagttacagagggcagcctgggaacccagtgggtccccgcacttttccaagcagccctgccagcctgacacgcacacctctcttcaggctccctccacgttctgtgccccttcccagtacttccctagtgccagggctagctggtacaggttcacacccctcctcccttcctgcagcccgcttctctgctggtggcacccggaactccctctaaaaaatgtccaggtattctgctcacaacccccaatgttgcactcaacatatgggcttcaagaattcagttagattttaatagagcacatctctccagtgagaaagttaaagggaagataggaatgacctagctggctcactgtctgcttagcacttaaatctgccatctgaaaggtaatcttgtacagaagaattccagcaccttcatcaagtatcccccaactcctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcagggaagctggggtgggaggggtgcagttatgacgaaggggagggggctcctgctgttgctccagctcccggagaatgaaacatgaacagtcgcactgtgtaattttaaattgttaattagcacagggttaattaggcagtcctttcacaagaggctgtctggtaggaaaccaagaagggaaacaaaggggaagggaggaaaaacaaagagagaatagaggcagtgagaaactgttgcctccaagaatatcccatgcgggatcactcaagagacatcagccagcaggcaaggatgcctgattccctgggtgatcccctgctctgccggagggagaagcagtgaataccgccttcctacaggcgaccaggcagcatacatcaaaggcctcagaagtgcacatccctccccgttgactcaacaattccccgttctaggaattcatcataaggaaagaacccaagcaatgcatggagatttaagtttattcatgaaaaacataacaggaaaaaagaggaaaaatttgggcaaaaacagaccctaaataaattacagtgcacagagctccatatgttgttataaagatgctttcttcaaagaaactatttataagcatgggaaaatgatcatacagatgctaaatgaacacagcacatataggtattatggagaggaaaacaggagagacttatattacaatttttacaactgtgaattctagggaatgaggtataggtgacttcatttcctcctatgtgcctttatttcccaaagctctttaaaattaaaaccatcattgagacagtaggattgctagagcccaggagttcaaggctgcagtgagctacgatcgggccactgcattccagcctgggtgacaaaatgagacttggtctatttaaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctgactgacaaaccggagagtatgggtgtggagtctatgctttcaggcagttttcctttgtcacccaggctggagtgcagtggtgcgatctcagctcactgcaacctctgcctcttgggctcaagcgattctcctgcctcaccctcctgagtagctgggcctacaggcgaccaccaccacgtctggctaactttttgtagttttagtatagatggggtttcaccatgttggccaggctggtctcaaactcctgagctcaggcaatctgcccgcctcggcctcccaaagtgctgggattacaggcgtgagccaccgcacctggcctgtttttctttaatgtctaattttcaaaagagaacactagaacatccctacatctcacattcacactcagtctttaagcacccagggactgtcctaaggtgatgggatcccaggactgctcatgcaaaagaacgctggcatctcacccaaacgcccttttcttgcttgagagtgatgggggtgaggggaacagttcaaagcagactgatttgcttggatatctttaggcagacaagagaggataaaggaggtaggagaagctgctgcaaagaactgaaatgtaggtccaatatcctgatttttaaagaaggacaaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaacacagaggtccgtgtgtctcgggacacgccaacaaggctctgtcttgtccctatttggctgactgaaatcaacagcttgaggaacaagaccatgcaggcatgtccacttgcagagcacaccagactcgagggaacaattaaaatgctcaacggtggaatcaagactgaggaaaaaaatctccatgagttggaacaacaggcccaaactaacagaacaaaactttagatggaaaaacatgaagccctacatttaacttcaggcaatctgctaaaccaatagaggatggaagagacttggagtcataagagttcatgcaaacaacaataacaaaatatctaggagttttacttgatgacaaactcagaggaagcccgaagttggcatggtggccaaagaccataatggggcctttggcaacagtactactctgtacctgttggagctcagcaggtccacagcccatcactttctctgtctgcgtgaataatgttaggaaccactccagggaatctcctaagagagataccaacaaagaagctgtagcctcatcggaatggctgaacacacacaccattcacgggtgcagggaagagaagtcccgttgcagggcaaggcagctatcctcggctatatgaaaccctgcctgccacaggcaagtgggtttggttctatgggttccacctagttccagggttgaattaggggcaatgaggggaatctataaggaaagagaggtggggtcactataaatgaaaatctttctcaagattatcacagttcccaaatggaatgtttatgctgtgaaatactgcactctgtggcttcaagaatggagaaggggattgtgctatggccagggggctgtatcaggcagcctatgaaaggtgaagattcttctcattcctgggtgttatctatgggcttgtctgtccccaccacaaggctatgagtggcatgagatcaggttccctgtgctattcatctctgagtcctccacatctgacatgtaataggtgcttaataaaacaatgggggaaataggaaaaaagaggatccctgaatccattccttttctttttttctcttagtttaagacgtgtctggtgtaaccattctccacaaaatggaactggggctccttggagacatggccaattcttgggctggagcaggaaaagttcaagatgagctcggagcatctacttgtgctcaaagaataaggaagatgtgtcaaaatgacctaggagtgggttggaggggctcccagtggccacatcagggacaacgtgagcaagaaaattaagtgacagtaagtgattgcaacccaatgtgtaacataacaatccccaagtccctactttaagaaaaaaaaaagtgtgggagaaaggaaagttcttccacagggtagaaactcaactaataaacgtagaaaaagagtatggagttagaaaatcaccatttgataaccatcatcatcttcatcatcatccactcagggaagaatcaatgggtacccaaactaatggatgaaagtttgaatacttccgggagcggtggctcacgcctgtaatcccagcactttgggaggccgaggcgggcagatcacgaggccaggtaatcgagaccatcctggctaacacggtgaaaccccgtctctactaaaaatacaaaaaaaaaaaaaaaaaattagccgggcgtggtggcgggcgcctgtagtcccagctactcaggaggctgaggcaggagaatggcgtgaacccgggagacacaacttgcagtgagccgagatcgtgccactgcactctatcctgggtgacagagagagaccccatctaaaaaaaaaaaaaaaagtttgaatactaacaggatatttacaatctcaaagtctctccccacaggatacttcttaattatagcaggaaaaaaaaaaacaacaacaataacttcactgtggagaacctggcagacaccaccttcattgagtgatcaaagttcccatcaccagcagtggggcaaacagacgtcatgtgcctcctggtaggatacaccgagaggaacacaacatcccttccctggtgttcctgtcaaaaacgcacaaccggaatctaatcatgagggaacatcaggcaaatccaactgaggacagtctgcagaatgtcctatgctttttagaaatgtcagggccatgcaacggaaagacagactgaagaactgtttcagattaaaagagactaaggagacatgactaatgaacgttatgcataatctgggatcttcttttcctctaaaggacataactgggacaactgacaaaatctgaataaggttttgtagatgggctaatagtggcatatgaatgttaatttccttttttttttttttttttgagacagagtctcgctctgtcgtccaggctggagtgcagtggcgcagtctcagctcactacaacctctgtcgcccaggttcaagcaattcttctgcctcagcctcctaagtagctggaactacagatgcccaccaccacgcctggctaattttttcatatttttaatagagacagggtttcaccacactggccaggctagtttcgaactcctgacctccagtgatccgcccacctcagcctgtcaaagtgctgagattacaggcatgagccactgtgcccagcctcatttcctaattctgataactgcagtgtggttataaaagagaatgtctttgttttttaaaatacacactggtatatttagaggtgaaggggcacaatgcctcgattttcaaatgggttaggaaaaaatatgtgagtgtgtaagtgtgtgtatgtgtatcagtatatacatacatacacatacacatatatacacacatatatatgtacctacatatatacagcaggaataaatatatgagatgttaccataggaggagtctagaaggaggacacgagaattctttgttctactgttaaaacttccctgtacacttgaaattgttaaaagaaaaagaaactgtccagagtaaaaattcgacatagtaaccccccaaaactataaacgaagagtcaacccaccctgacatgcgtatctttaatctttatgtgaaatttgctcccagcagagcttcaaaaaaggaagtggctgtgaggctggacagagaggtgtagagagacaaaaactgaaaactggtctccccttcctccagccaagaggcttctaggtggagccttccagttggagaagacaaataaatggccattccaacttgggcagaacttcacgtaatacaatactgagccgtttccccgtgacactcatgatcctgactgtgggctgatttccctagttccctagggaactttcgcaaagttccctaactttgtgaaaagtgattctaagtaaaaggacgagggcagcccccagagaaaaggagaactccagcagcccccagagtgtgagcattgttaaatccaggctaaaacatatcagagagaaaaacacactacactgaagcaactatcccctcactaaccccacctccttaaaaaaacaaaaacagaaaaacaaaggcaacccagattccaagagaaggtgaaacctccttcaagggtcaaagaaataatacctgcatctgtttagcttggaatccactgaagaaccatacccagttcccttctgtgtttttttacaataacagtgtttgtctactgctgctgcacagaagtcaatatgtgttaagccatacataggtgattccatctgcttggtagcaatttcccagcagccttcaggattgctctgcaagtgtggccaggtcggagaacacacaggtgcttgaacaggcgccttgtgctgccggacgcccactgcccagaaggcccagagaatcgcccaggccgtgggcctccatgtttgctaataagtgcatctgtgctatttccagcatgaacataaatcagcctagaagtgaaaactgctagctcagcccattctgcagggaatccacaaccaccatgatattctggttacagtggagtcgtggagggcaacaggagagagtcgtgacagcggaggcaggtctaggaacccagtctgtgtgtacttagaggaattaaaaaagattttttttttttttactatatatgtaaacatactcagagttcaaccaccatgaatcaaaaccaaacccatgaatataataataaaaagcaagacaaaccagctattatttatgctctgccttgttctaaaaagggatttggggcaatttaaacagctatagtaactgtatctcacacttgagtacgtaagtctctaccctgagtcacgtggaggcctttccaccatttccacaacaagaaagacaagcatcgtgtgcccatgactggcttgactggtgctcctgacttggatttaattaccatagagcacggatcccctcccggatttgcagcagaacctcctttcaccaaataccattgctttacctgactgtaccaacccacctctcctaccttgcaagcccgcagctcacaaccccaaccttcacccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaatgtaaaaacgtgccatctggcccattacagtttcaatctggcatgtcatgatgtcaaatttatgttaaatcatgtcttatgattaaagttgtgggagttcattattttaaaaatttggatatgtacaaaaagactcagcagctaaagttaaaatcactgacaattccaccagctagagaaccactggtaggtagtttttcgggcttttttcctctgcacgtttacagatacagattttccttacctacctcggatcacgctgctgtttatgtaggccgcccttttaacctaatttagtatgaaatttttcctatgccattcaatattcttcataagttaaaactaatggctatatagatactatatcttatacacattgcataatttccaccaaatgctattattagacatttaaacaattcccaatattttgctgttcattttgcaataagggcccttaaatctttgtacacatataacaacaacaacaaaaacaacaaaccaagtagtagctccattactgtccacctggttgaatcaagcatggttttgagcactatttttctgaacatgttgttttgtttgatccttgcggcagcccactttacaggtgaggaaactgaggcttagagagttaagtaccttgcccaagctgcatgctagtttagtcggcctttgaaagtaggtaagcctcccttaccactctaaaactaggctcttactcatgacgttgtgtctgtattgccttaggatgcatttctggaagtagagttgctgactcaaatgctaggaacatttaaggccctctggaacgtgccaaactgtcccccaggaaagtcctttccactcctgcttgcactggtgtgtgagcaccagttttcctgcaccctcatcaacagtgggtatttactttgttatttttaaaagtccgtttgacaggcaagaaatggcatctcattttaactcacattctttactcataagacagaacccatctatggatatttactggcagtctacatttcttttgtgaactgcctattaatttttttttttttttttttttttttgagacggagtttcaccctgctgcccaggttggagtacaatggggcgatctcagctcactgcaacctccacctcctgcattcaagcgattctcctgcctcagcctcccaagcaactgggattacaggtgcaggtgtgcaccatcacggccggctaattttttgtagttttagtagagtcagggtttcaccatgttggccaggctggtcttgaactcctgacctcaggtgatccacccacctcggccacctaaagtgctgggattacaggtgtgagcattcatgcccggccttgcctgttatttctatggcaggtgtgtgttgtccttttctgagtgagtaatgaaagggttttgcagaatttgactggtgatccctcccccttgagttcctaccagtccaccatcctataagctcctggacaggagagagtctgacctacttacactgccagttcagaagatgttctctgtccttcagatctcaactccatccaaagagtggactctgtccactgcttcatttgctccacatcaattttcctgtattcaagtgaagtccccctcctttatgtgattataaagggccaaactgcatcaatcattttcaagctttcttgtgcagtggaaccaactatgcggcacaataaaaatacatatggatgtcaagccccagcccagagcacaagactagctctctgaagggctgggtatctgctccgggagggtgggaaggcactatgtcgccaagatttctgtcctctgtccaaagtcatcggtgtcctcctggtcttggtcaatggttcctcctcctctactttaagcttcaatctcccctgcattcaaaactgcttccccctctactccttgaaatcttcccccacttcacttctgacatattctggccctcctcccacctctgtcatctctacattgcctgtcctctccccattcctacagctctccatgggtacattttccacttattcgataaaattcttttatcatttcaactcacagacatctctcctccctgttctcctgtaggtatttaagcgtcattgtactcttcccccttggctctctgctcttaactctgtacatcagctaccttaactacttctgcggtttcaattactgaaattacgagctgactcccaaagcaaaaatgtccattcctgacttggcacttgaatatgtgtctcatactttcagaagaccagaagatgtctgtacatgcctagtgtcccaccaaccaagactcagcatggctcaacatgtccaaaggacactgccccctcactgtcggccctggtctctctggaaggaacttttggtgccatctttgcagaaaacagaaaggaaagatcagtctggctttcccaatatcatgttcatccccatccttccccatccaagaaacaactaccaaaacacattcaaactgaaactctccagagcggtttcaaatcaccccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtctactatggttcctaagttcctattaggtagctcttagtcagcagaacactaattggaacagaagtaagtgctatcattcaaggctgcacaaacccaagagaaatgaacttggtcagattctttgcacttggcagtttggggaatgcaggcagaagcagccaggagccttaagttttcttttattcacatcgaatctacctgagaacaaatgaagaacatggtacagctgcttttctctgggcctgtggcagctaattagagcacctgggaaacaccattcaacgttgctggacagaggtacgtcctcgcaatgattccgccaaatggcacacacaggacaatggggaaaacctgtaagggtgaggtgagagctggccttgggcgaaggaaagtttcccacagcagttatctccaaaatgactctgaaacaaggagtgtgttttcctctcggcaggaagaaaaccactcggtgggctcaccatcggcagcttgctctggcacgaggctccggaactggcaccatgacaaaacaaacaaggattgccctttggaggctcactgatagggcaacacacacacacacacacacacacacacacacacagcctctcaccaacacgggcacagcgagttcttcagatatccctggcctgctggcataaagagcttttcaagcagtgggaagccaaagggacactcaacaaagcagtaatggccactgtaaggtagagacattggtaaaggcatgaaaaggggatgcctactgcaaaagcaaaatcgtacacggggtcttccccatgccttgactgggcaccctcgagagacccctttgggatgtgcgtactaagcttccacccaacttcctatctggtggaggcatgctatgcacagagaccccatcactgaattccctcctagataactcactgcactagactgaaggcttgagaggtttatttcatcatgagtagtcctcaaatcctagaggcccagagagttgctcctatctcgattctctttcttagggtaaagtgaaccggcagcaagaactaccaccaggacgcaagggctttgagacagactgaagggggcatggattctgctggcactctgagtttgtttgaaagacttccaaattccaaagcttaaaaccctatcagggccaggtgtggtggctcatacctgtaatcccagcactttgggaggccgaggtgggcggatcactggaggtcaggagttcaagacaagcctggccaacatagtgaaacaccctctatactaaaaatacaaaacttagccgggcatggtggcaggcgcctgtgatcccagctaactcaggaggctgaggcagcagaatcacttgaacccgggaggcagaagttgcagtgagctgatcgtgccactgcactccagtctggaagacagagtgagactctgtctcaaacaaaataaaatacaatacaatcaggagagaggggtgtacagggggaagagaggggatcatgaaacgtgatcacatgtccccttcttcatggccccttctccatcccacatggtaattacaaagcccattatttgcactgttacttttaatcaagaaatccatattgagacatacttaccactggccacttcaaagagcggccctgatagttagctaaaataacaaaggaaaatttcttcttgaagtgtaaggatccaagagctcacacttccttaaccttccagaagccacccagagaaccaagtgactgtgggcaataattacaccctcaccaactcagcaaaaatggcacagatggtctttctcctcttgctgctcccaatgctgcgtttgggtcaacagctgctaagaagaaccaccaaggccacgttaaatagtacttggattaattatgcttgaaaatctcttatctgagcactgctaagacagaacaattgagtttgggaatgagtgtggttacatatttttccttaatggcttcctgaacaccctggttaggtctggtcccaggggagaaattgccagctcaagtcataaaatgtgatcaatgtagatcaagaccctgtgctaagtgtctaggatgaaagaggggaagcgtatttgtgcaaacacacaaacatatgaaaaatgcatgttaacataaagaacttcagctttctttctgaagctgcaccctctctcctttcatgcctagagctctgctcattccaccaaaacttccagccagcagttctaatcttggacagcgccagaacaaattttggcaactgttcctgcagttccaaaagattcccatgttaagccatggtaagattcggggaatcaaatctggatggtgaatggggccaatttctttgacttcaataacacagaggctactggggttccagccccagtggtcatagttttaagctcctctgcataatacttatccaactactcactggttgttctaatgatttttattcattcgtgccacaatatttattgagtgcctacaacatacacagcgcgtccctcctgtcgatacagactcctacgagcttgctctcagtagcgtccaggcaggcaaaggaaggaactggaaggcagtgatcaggaccccggtagaaatggactcagcactccacgtggccactgggattcactatgtcaacacaattatctgggttactgctcgcctcattccagagtctacctgctctgatgccagaatctgtccttctattaacaaggtgtggtcacagtgaactgactgaggtccactgtgtttaaaaacactgaccatggcatctcatggctggacaagtggcaccgccgccctgagaccctgcagtgctggggaacccggaggccctgagacctcggttcaactccgccagtgccccgggagttctaacccccacgggggtctcgccttcagtccacatgggagtcacccatcaaaggcattttagggatattttaggttgaccatttcctgacagcccaacatgtttttctctgggatgaagggcatgccatcccacaaatggtgatgagaaattgcagaaccactgaaccggcctacacataagcatttcttctcctttgatgtcgagttgacaagaaaggatatgatttcatttctactggctcctcttaggtaacccaactggtttcccacttcctcacctgccctttgcattcccatcctggtttctttggccttggttcctctttaagctgggaccagcgactttataaactccacacacagtgcagcaggttccagacgcagcgtctggcctccccaggtcttatgaagaggtgctgagggttggcgggttgacacactcactgcactgcacaaggaggtggctcagcccagctttcacgtgaccagtgtccatttatagggtcgcatgctcacgacacatgctgcattatggggaatgctgcagagaggggagtcttattcttaaaggagttagaattgaagcataaagtctaggaactaacatgaaccacctcttagaagtctatgtacaacctgcactcgactttgagttgttccccaactattagttccctgtcgtgggtcagtggggggaaaaaaatcactctccacacagctcttgaggagaggctgggatctctacgattcacttggtgtctacctgcaggggactcagggaaaaaaaaagcaaaagccacaccagcatgagcatatcacacagaaattctactgaccccaaaagcggggcaatgaaaatctgtgcacaatttcaaaccatgcaccccagggtggaggggagagatggaattcaggggaagtgagaagaaaaaggggaagaagaaaaggaccagggattttttttcttttttcttttttttttgagacagagtctcactcttgttgcccaggctggagtgcagtggcacgatctcggctcactgcaacctccgcctcccaggttcaagcaactctcctgcctcagcctcctgagtagctgggaccacaggcgcacaccaccatgcccagctaatttttgtatttttagtagaaacggggtttcaccatgttggccaggatggtctcaaactcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgttaattgtgggtttttatttttatttcctattaccctctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaaggggaggccactatacaacagttgtaaagatgtcctccagccagtcatagagatgatcctgaaggcacttaccatttattgagtgcctactatgtgccaggcactgtgctaggtgcttaccatgcccagactctggtcctcacctaaccctctaggacagatgttcttctccctctctctcctggatagatgaagaggcagaggtctaggaaggtaaaggagagaaccagttggtaccaacaccttcctgagggtcaggccaaactctcacaagcagcaaaggaaagctgagtgtcaacaggagagctcacacctgagtcctaagagagcgtggagcacatgtgatgggctactttactcttttacagatgtagcagatgatagattgtgactaatccacctccatcatcctcagcacccaacaacagcgctcctgtgtccaaggctggaaccacaggtgggcttctcttcggaatacgcagaatggttactgttttagcagttaagatccctccaactgtttgcctgccaaatattgctttgcttacctaaggcctatggaaaaaacagcaaggagctcctcaaaaagacaagttctatgaaaaacaccaccagccaggtggctctccagacctccacaggccatttcgccataggaaagatggatcacagaagaaccagggcacagtccgaaattaacactgctccccacaactcttcactgttaaaatggaaattttacatggaccagtgatggcaatgtgtccaaccaaaatctctcaggaagcttttattgagtacctaatctgtgcctcaacaaagcaaagaatatataagacatggaccccgaaatcaatgcgcttacagactaggtgatggccccataagaatacctagcacacagttatttattgatcctgtttacaatatacaatacaacatcatagcataaattgaggcccgggcaaaagaagaaagaaaaaacaaaactggaggaaattttgaaccaaaaaaatcaagcttaaaatgcatgtaagaataacctacacactgagtcaaatttggctctaagctttctaaaagtcaagaggataaaggcatgctaggtatgcttttaaaggtacactatttacaatgtccaagagaaaaaaaaatcaattggtcaggattatttagctccagtaatttctcaactgctgagaatgggataagactaggtgcaagtagggcgtgcagccctatttcccggatctctttgtggaggtaataatgagaaggcttgagtgtgaggccagctagtctcactgtttccactgatagacaagaatactgaccccacagggtgttggtggtttgctgacgtcagagagccggtcagtggcagagctaggacgaagacctgggtatcttcacaccacactaacagtgccttcctcccacatgaagctactccgcatcatccttttaaatccacaggctggctggatgggtaggggctcacatggacgttggggaaggaggagaactgttctagattaaaggggacctaagaaccaaacaacagctagatgcgctatgtagtttcgtatggatgccagttctaaccagccaaatgtaaaaagccattttggggacaatcagataagtctgaattgcaacttgggattagatcatgttaataatgtcagttttggccaggggcagtggctcaaacctcaagtatcagcactttgggaggctgagacgggcagattgcttgagcccaggagtctgagaccagcccgggcaacaaggtgaaaccccatcactaccaaaagttaaaaaaaaaaaaacaaaaacagctgggtgcagtggtgtgcgcctgtagtcccagctacttgattgcttgagaccagggaggtcaaggctgcaatgagctgtgatcgcaccactgtactctagcttgggccacagagtgagaccttgtctcaaaaaaagtcagttttgttagggaataatattatgtttacataagaaaatgatgaagcagcatgatatcgttggcttcaaaatatttcagcaacggacaaaaaagacggaacaaatctagccaaaagttcattgttaagtcaaggtgatagaactatggaagggttcattatatcattctttctacttttatacagtaattttttttttccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctcctttcaaacaccaccatctactgacccccactcttactccttctcttagaaggtaccaagcaccaccaggctgctaatgtttaaaagaacacagaaaaagacaatatgcatcacgcctgggcatagcacctgacagcctttataagtggtagctatcacgatcattactgagcaaaaatgcgcctgtttacaaaagttaacagcctaaggttatataacagcttgatttcaagctttgagccaaagtctgattaagaagaatatacatccgttgaattaaaagcctccacttcttgactcaacgggttaagaaaatatttttaacactttcagtgagtttaaaaaatcagatgtttaccagccattgtttttgcgcacactgtcttttatctcagcatgaatgttttataagcaccttaattgctttgcaaagcctcaactgaactgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacattttcaaacactctcatttgacctctaacaatctttttaaatagaatgggaatcatattttcgattttacaggtttaaaaaaataattcattcaaacatctgagtgactcctacgagtcattctttctcaaggtcctgcaactggttagctgcagagcaaggaccaggacacaagctacagtttctactgtggtgctcttggctccatgaaggcatcatttccttaaagagaatcaccaactcacagagaaacaagaagaataaagacagaaacctacctgctgcatgcctaagcttccaaatccttccaaaacatgtatcatctaaatacgagaaaaagataggatgccaaagacccaaaggaggtattttcattgatcacacctcagtggagtagagttatacacaccaccaaatattgagttgctccacacagaccagaacagtgatggcaagacattaagtcgtaaatttttacataggccagaatggtggagggcccgagaaacaaatccactaaagcaccaagtgctgaagcaaggatctttggcccataaaaaagtttaagatctgaggagtagcctgggtgcaactcctcctcttagaccctagactgcaaagacaacactgtcatccaaagcagactgaccactcggctcaaaaggctatttgtaaaaagatgtaataagctgtcaacgtccaggagctcctcatgaaggaggctgaactcagaggagctcatgtcaacgcagagttcaggttaggaccagtgggggtaacgtaaagggtgatttgggccccaggattactgtagcatgacccaagcaaagtgcacatatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttcttagtccaactgactaagctgagtgacatttttaggaagagcattaatgcggaaaacaaacctttccaattcatggaatgaggtaatctgggcagaggaagggtgggggcagagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagcaacatagtaagacccccatctctacaaaaattaaaaaattagctgggagtggtggcacccacctgtagtcccagctactcaggaggatgagatagaaggatcgcttgagcccaggagttcgaggctgcagtgagctatgaacgtgcccctgcactccagcctgggtgacagatcaagatcttgtctcagaaaaaaaaaaagagagagagagagaaaggctgcttaagccattgctccatgcaactctccaaccacatgtcaaacaccattcctaccatctgtccttggagcccttccctcaccagcacaggtctaactacccactgccaagtgtgggtacagggtaaggccctgctcagtaagcctgtggtctgatactaaagtcatatcttgccattaccccccggccccaccagttatagtccagaaccttccatcttgctgttggctctctatggcctggcttcctgaccctgttttgcatgaacccttgaccagctggggcttaaatcccatgggtgggaatctcatacacctgcagccttcttgcctatacctgctcacgctccttcaagcacaggcctcagcccttatctgaataacctgtctgctggcttcctccccatctgatagtttcactcctggctcctctcaggcagcaaagaggaataagcaagccacaggctgcagcctggcaagacagtcaggaaggtggcagctgccctgattcaaccttcctcctagtctatctactgcctcttcctcctccattccccagtgactccatgaaacttgtgttcacaaacttgaaaaattcactggtgaggccaggtgcagtggctcatgcctataatcccagtactctgggaggctgaggtgggaggatcacttgagcccagaagtttgagaccagcctgggcaacacagtgcgacctcgtctctataaatccttaaaaattagccagacatggtggtgcacgcctgtgaatccagctacttgggaggctgaggtgtgaagatcacttgagctcaagaggttgaggctgcaaggagccacgatcacaccactccactcctgcctgggccaaagagcaagactctgactcaaaaaaaaaaaaaaaaattcactgaggagatgtggtagatggcttagaggtcaatgttataggtcaatgtcccttaggttgaacagcacctgtgttgctgggtctgcaatgttgaggaccccgtgatggtcttcaataaggctggggcgaaggggctaaacctcactatcgtgtgcaagctcaccccaggcctcaacagaatttatacatataaaatttatatgcattacatgtttacatatgtatgtatacatgtacatgtatatagtatacatatggatatatttatataaatatgcatatatacctatacacatatacacatacatctctcatatttaaaacaaaatagagcaattaaaagaggaaaaaaacaaagccaacacacacgtacccctaccaccaccactacgaacaccaacacgcccccacaggcaagatcttgtcccaagtttctgagaaacgtcacttaatactacgtaatctcgaaatgatggggtctgcctactggctttgtctggagactggactccagctgctctcctaaactgtccttgtcaccttctcatcaggagaaaaggggaacgtaaacatgaaccacaccagagatgggctatccagtgaggctgatatcatctcaggcgccaccgacatctctctccagcattctgtcatcttatgatcaactatgtaactccagacatccaggggaacctgaatcctagaactagatgtccccaaataagtggtttctctgtaaaagtcaaatgtggatcacaaaacaaatgtgaggggagtcccaggaaagccagttgcataagggtgtcctcaattaaattctacacacgtcaatttttccccagggagggcgaggcagagctgagaacaacattggactggacagactcaaggcagggaagaaatggaattttcgctcttgagattcaaattcctgagtcatagttgaaatcccactgctataattgttttaatacactgtctccacacacacaaaaagacgcctttaaaaagttgtactggcttccagattccctggttaaaaccctcccttctcctggacgctctcagatacaagctgtgttgaactcactagcagctgtcacattctggcacttgcttgggctgtgaccagagcagtcttccgcccaaccagggaaggcacaggctctgccggcagagcaggggttaatggaagctgaccgcagcacagttgttaaggtaatcaataccactgagatactaaagcagtgtaagccacaatattgattgccaagcagatgataaaactgtttattatgataattgcagggtccctgcaagatgctcccagcgcttcctaaagctgtttacaaaactaataaagatttgccatttcaaggtcttccatttttaaccaccccccaccccgccaactccccacaatctcccactcccaaaaagcaggcctcacccctgggcggttaacatgttcttcccagggacaggcactccatggcccgtcctgggtggagcttcactctcagattctctaaagaacagactgtccttctccaccctcaccctgcccccaacttcaggaaggggaggacggaagcacagccgacagccactcagggccttcagatttcctccttaggacccgccatgtgataattatggggttttatcgatggaggggggctgctcagggctccttgggctgacatccatttgttctaacacatttaagaaaccacaccaccttggtttgtaattaaaacttctctggagaacttggtggccatgaagctaactgaacatggtcaaatgctgattgtagaatgcatttccgccaacactactcaactgtgacttgggctgctgaactgggcttgggtcccaagttctatcatgcccaaggcacccatttagtttttattagcagtggaaattaactccttcttggtcacagacaccaccgttttcctcgagacgcaagttattgaattatcggcaccgtctccaatgctgtcacctcatgttcaagaggaactgcaatgcagacatatttttcaatataagtaggcatctcgcaggtagtataatcatgttcttcggacctcttaggggaaagccactgggtcctgcgattaaggatggcagccccaggacttcagggctctgcaaatataccgaaggtgtgttttcagagtgtgaaatggaaaaaacatagaacccagccaggtgcagtggctcatacctgtaattccagaacttttggaggccgagtcagacagaccgcttgagcccaggagtttgagatcagcctgggtaacacgacgaaaacaaaaccccacctctacgaaaaacacaaaaattagcaaggtgtggtggcgagcacctgtagccccagttactcgggagactgaggtgggagaatcaccagagtccaggaggctgaggctgcagtgagttgtgggagctgtgatccagccactacacgccagcctgggcaacaaagtgagatcctgtctcaacacaaaacaaagaactcaagttttaaggagaattcagtagtcattccatcagcagctagaaggcaagcacccatccctcactcaactctcatagcagctaagaatattttacctgtaatagacttctacagcactaggccttcaaaacaacatttgcaattgaagggacaccactttgagagctgacaggccaaagtaagatgatgtggaggctgcttccacctcccaccctccccgatcaaagcatggagaaatcattcaccagtgctcctggtctccgttgccactgccacctcagtttaggtagagggacctctacctgccctattttcttcccattcagctgcaaccagcagctctgggaggtcattgcccccacactgtgcctgtgtacacatgtatgcttcaatggtgtggaccagtacagacatgcagctcctttatagacatctggttctgccccacctactcccaaacacacagaaatcagaacactggagccagttttatgtagagtatcattcgtttgccaaagaccttgccatgaactcatggataccacagcatggctggaagggatgcaccagggattcctttaacctggctacctgctcttagaggaactatttggcaaccaggaatggccggagggaatctgaggcttccctaggactgcctttcatgaatcacctgctcctaggcaaagtggcaaaggacagacaaacgccacctactgaactccaagctggacgccctattcattcacatatgctcacggggcccatgttaacaaacacctccctggatttgataccaaaagaaagtttaatattatatgtggctaattctgctgttaccttttaacctcacttgcacatatctgtcctcccaacaataacttcagcaaaaaacataccctaagaacaatatggtccacacttggaaacccgcccaacagggccagtcgagcctgcataagtgctaagaaccatttaggagcactgtaaaccattaaggccattagctctaatttgacctccacaaaatacatcaacccactaggaacaaatttagaagctttccaaagtcaagttctcaaaacctgaaaggctcataagcacagtctagggcagggaacagccagccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggaattcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaagcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactcttggcctgggcaagacagcaagacgctgtctcaaattaaaaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatactaggtaagtggacagtgcacatggataagtcaacaatccttcagttgcttcaatgacaaaaacataccacatacttatttcactcatctttccagggcagaaggaagaaataagtgggaagaatatgggccaaatgagttagcagtaacaggagaagcaagatgcagcacacagagttctacagcccaggaagaattgccaaaagctgagtaatccattccagctccaccctgcatgaatttccaggtatcaaattatatgttaattatgcggacgcagagttatatgtggggaagtggtgttagtcagcacccaaggggtggaaattcagtaaaaatttagttttgtcaagtatgtttcatgcacaggcctggggctcctctggctcaggaaaagagaaagcaggagtcaggaggcccagacctttccctaacagggtcccacagccaattcgctggccctctctagaccaactttcccgaattataaaataccacaaggtttgggtttttttccccccaccgtttctgttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaacgttatcagtctcacacatcgtgcccctgcctccaaggcccccatcaccacatactgatcttgccctgatttgaagcgggcgggagagagctatggggaagtccaggcctgtcccagccacggatgggacaaacagacaggaactgagtgctgaagaccttgctgtagctgctgagcgatcttaaaagggatccaccctggaggagctgagcaccctcttctttccagttctcctcactttaaacgatttttgtctaataatgtacccaacaggcagatatcagagaagcactaaactaacaccttgaaatgggtcaataatggctgggcgcagtggctcatgcctgtaatcccagtactctgagagtccgaggcaggtggatcactcgaggccaggacttcgagaccagcctgagcaacatggcgaaaccctgccactactaaaatacaaaaattagccgggtgtggcggcacatgcctgtaatcccagctactcgagaggctgaggtacaagaatcgcttaaactcgggaggcggaggttgcagtgaaccaagatcgcgtcactgcactccagcctgggtgacagagtgagaccctgtctcaaaaaataaaattaaaaaaaaaaaaagagagagaaatgggttaatgacaaagaagtcctatacacagcatagtatgtactgtatagcattaggataatatagtatagcagtcccttatccgaggcttcatcttccatgacctcagttacccacattacagtacagtaagatattctgagagagaggagagaccatattcccataactgtcattacaggatattgttttaattgttctattttattattagttatcactgttaatctcttactgtgcctaatttataaattaaattttatcataggcatgtaggtagagaaaaaaacatagtctacctagggtttgatactatcctccctctcagacattccactaagtgtcttggaatgtctccccaaggataaagagggactgctgtcgtggctaggagtatatgctctgagctggcatcccagcgcagaggccatttaacagcagcaaatttgctacagactttgggcctcaagttcatcactcatatgatgggtgtaggatcatctttaccccatagggttgtaaggattaatgagacagtgaagtatttagcacagtagatgcttaataggggttagctattaatgcttatattaatatttattaacatttatacagacaaagaacatgttctcatgtcatttgcatagcaatccaacaaaggccgtattctcacttttgaggctcagagaagcagagagacttgtccatggtcacacacaagtactcagacttccaggccagtgtcttttccatcatcttttttcagggtgtttcacccacgcaacactggccaggggctagatggttccaggtgggagtgggtgaactttgtacattctggtcattagccagtcaatgtttatctgagccaatccaaccagcacgagcctgtgattcctcagacacaattgctcgggatgatgctaaggtgggtatttgtggttataacggaggatcccgtgaaaagaaaaatgtaaagcaaataatacagtataggcagtacaaagaaacaacagaaatgatgccctgagttgggggcagaggggtctcttccactctcagaggctgtcgccgaactgatctttctcacatagtcaaccattaaaagtccccaacccacaggtcctagtttcttctaagtatccatctccctccttgctagagcagagcctccaaaatgaaagcgtttctccgccttcctccaggcctcctgagaaaggttatgagatgggttatcagcctctctgacctctgcagccatcaacagcacttctgcctctcccatcccccacagcgaggatcctacagcccagagccagcttccctgccttcccccattaatgcctttcccctccaacagctatcacaagagggctgtttagtgagaggacctccggctgacctttgctgacaggctccaagctctccctgtaaacggatctaatgtgaggctgggtaattagcaaccaagtagtaattgcagcttctaactatgctcggccaagattgcaaaaattccctaggggggtgcctcctagggatcccaacccacacaaaggcatttactcacagccaaaagaggggactcagccacatttctcatggaggccagcacttctctaggtcttaattaaagtggcacccatgtaaagagacagacagcaaaaggaaattagcaaataaaggagactgaccaagaaagaaatgtatggcttgcttggaacagcccattcagaaaggtacaacctctcaaggtggatggccgtgcacacgaaactcattccagccgcggaaggaaggcaccaaagagccttcgaggggcatcaaaaactgcagaaaggccaggcgcgatggcccctgcctataatcctagcactctgggaggctgagacgggtggatcacctgaggtcaggagtttgagaccagcctggccaacatggtgagaccccatctctactaaaaatagaaaaattagccgggcatggcgctaggcgcctgtaatcccagctactcccaggctgaggcaggagaatcgcttgaacctgggaggtggaggctgtggtgagccgagatcgcaccactgcaccccagcctgggtgacagagctagtctccatctcaaacaaacaaacaaaaaaaacaagaactgcaaaaaggcaggacacatgaagacaggtcccccggcctggctggccagcctggctgcctgctcctatcacccactcaaccaaaatcactcctcacccaagcaccctgtatggcccactgttcgcatcacaagattctagatgccaggccatgtggtctatgctaagagatccgtagtatcatctgctatgatttggtgattccaccagacctgtccacaggcccccctaccgttagctgcctacatgtattaacatgtttcagaataacgtgcaaaatccccattgagaaataaagatgtgagcacttccaaatagagcagctgccctcctcatgactctaaaaatacctaaaactgcacaaaaaagaacattgtcagacgaaaagaatcatccctcctcactctaacaggacaacaagcgatgcccaacagcacagcagcgcctgtttcatccttcctaagaaaaccctttatttttcaagcccaccactccccactccaatttcctttatctgttttgtacttaaaaagtcacttcactgaactgctgtttgctcacgataactcctgaacctctgtcctcaggagaggcggcaagttcagggggcatggtagctttcccacgtggaccagactttctgccaacctgaattacaccctagacgtcttcaaacttcatttcctctgccactgtgctgcccgatcccccaatgcattcggggctgtagagactctctgggttgaatccagttataaaaaccagggtagcagcagccgagtgcactaattcaccctccatttccttctccaaacaattaatatacttaataactccagccccgacgacagatttctcagacacccctctattaacctctccccgctacaagcagtgggtctccaccagaattcttctgttccctatcacttaatcattttttaatccacaacaaggactttgtgccacactgtggttttgttctctcttaatcttttataagggaccttatcaaaagcttttagaaaatacaagtgaattttgcctaccaggtcatctttattattttagaattctttatgaagaaattatagactttaacattgtaaatgaatatttaagactcagcattcacttagacatgcaagtctggctcaggttatatttaagtcgctgtattacttccaccttcagaaggattcttgtctgcctcctgggatggaatgacttcccctccccaagcccccaggtgccatttctgggattcccccaagactttctggaccagctgaaattgagtccatattgagtaccaatgggacttagagtgcattaacagaacctcaaaccaaggaacaaaagtcatcgagccaagggggcctggctatggcagcctatccgactcctacctcctctacctttccccaggtggatggcagggagcagcaggctcccctgcctcacagctggcccgcacatctgcagggagccaatgacagcttcttgatgttgacatcacttaggctgcctcctaacacttgtttgttgtagctattatttctaattagcacttctcaacagaaccagtgctcagcaccaaggttcctcctgacggaacaattaaagaggcacaaggggcgggggtgtttcctaaaattattctcttggcaggtttcaaggtaaatcatctagtcaaatgcacatctcttcaagagctgcctgtggacagggttgaaaagctgtagcaatattccggaacccctgtttgaaagcattcccatcaagttaaatgaagggttaaggtaatccaattacaccaatgtgttttcctgatcaccaggggaatcctcagccttccccgtaatctgctcctaacgccccatttagtccaatgctgcactccaatcaccaaaaatgtagacagggttcccactcctacagccagatgagaggtgcctgccccttctccaaaatgggatggtgaaattaacacatttcagaaaatattctacagagtccagagtccagggcacgctttatccttgaggaaaataataaatgtcgagtcctaatggcatgtcaattaaaggggtcaccataaacaagctgttcaaactttcccctccactcttcgcccgtgcctctccaatctgggtgccctggaggacggaacgggaactgcagatccaggcactccattatggcaacccagcaagcagttcagcacggacttaatgagctcttggaaggaaacaggaagtctataaagtaatttaaataacttccagtcctgaaataaaggaaattaaaccgctggcacaaacctctctgatggacaccttctttgtccctccgatcacaactacaactacagcggtcatattgctctccccaagaccaggccccaaattcccctaatatgaaacacaaaggctgtcagtcctcagagctctccaagctcctgcagaggcttaagccatggatgtggcatggtgtgcagcaagaacacgggaatccgcccacaaaccccgcgctgggtcctgccactccctagctgcaagaccttgggccaatcatgcaacttcacagggcctcagcgtttcaccatcaacaaaggaaagctctgggcctggccaaatgacttctaagattattaagagggtcaaatgagcacatatgagaacagcgccaattgaaaacacaaataaacgtcggtattttccagctgcccagggccttaggctccagaatttctcgatgttctgctcaggaggcactgtcctatcttggtaattatgaaggcatattcatacgttcttttactgccaggtgcggtggctcacgtctgtaatcccaacactttgggacaccaaggcgggtggatcacctgaggtcaggagttccagaccagcctggccaacacagtaaaaccctgtctctactaaacacacacacacacacacacacacacacgagccgggcatggtggcgggcacctgtaatctcagctactcaggaggctcaggcagaagaatcacttgaacctgggaggctgagattggagtgagctgagctcgtgccactgcactccagcctggtgacagagcaagactccaacataaaataaataaattaattaattaattcgttcttttgcttctcctaagcccctcagtgtagatacttatttgcatggacaatgatcagtccaactaagcatgattttcttatcagcagagactgtgtcttctcatcttctgtaaaccagtgtgcccagagccagagcaccaagcagccaagaagctggtcctcaataaagggctagaatctataacccatgcagttatccagacatccttaagcaccaaaatgctaacaactatccatcaactctctacaaaaagagacaaacctaataacaagataaattccataactggttgtgagcctacaaggcggggaggggctgggggcgtgggaaccccgcctgtgcaactccttgcattaccaggccctgccctgagtgcaatccaaccacggagttctggcagtttcacctggtaaacctaagctgctggatgctaaggactgtttctggccacagagttaagtttactttgttgataataatcagccagatatggactggtctgaccagtactccggatccaggatcacaaagaaaagacaaacttaaaagaagcttaaggtcagcctcgttttgctagccctctaggtattactactgacaactggtatggtcaacccttgacccctaaactggtaaaagccaagagtaaggctggacattcagtgtggccaagaaagctacccagcttctgggcagaagcgcaagatcctggtgctccggaaagagaaccgttgggcccggctcaaaaacagaccctcccaaaccaaccctgagaaaggaaatcacaaacagaaatctaacttttctataagggcacactgcacaagtgttcctgcagcttcacaaacaggttctgtgggaatctgctctatcgctcccatctgtcactggcggggtaagatctgtcttgcatatcatggcggtctccatcccactggagaattcaatggtgctgtcttgcatatgggctgtgaaacttgaacaaccggattctgagggtccagacgtctctgtttgagcaacagctgccttcctttaaaggtcccacagttgagcaatagagttctttactcaagagggctgttccaagtcttgagtaaccacccttgccctcaagggttccccagggtgaagccccattgcctctgcctcaccaaggaggcagcgactcagtcttctcgctacacatctgtctcctcactttccagtcagatcacagccagtgggacacaatctgacaaagttctgtctaaggtggggtaatctgaaaagcaaatacagatcatctccccccagacttattcacagcactccccactggagccaggtttgactttccacaaagttcactggccagaatcataacccacacatctatggctcttccttctttaaccatctttcatgtaaatccttcatctaaaaggggaaccacctatctatgaactttaaatttcccagtatccatgttaaaaaaggggaggggcctggtgcagtggctcacagctgcaatcctgacactttgggaggccgaggcggcaagatcgcttgagcccaggagttccaagaccagcctgggcaacacagggaaagcctatctctacaaaaaaagaaaaaaattagctgggtgtgatggtgtgcacctctggtcccagctactcaggaggctgggataggagaattgcttgagcctgggaggtggaggctgcagtgagccatgattgcaccactgtactcccgtgatttaaagcaagaccctgtccaaacaacaaaaatgaaaacataaaaacaaaaaaataattcaaggctaggtgcggtggctcacacctataatctcagcactttgggaggccaaggcaggcagattacctgaggtcgggagtttgagaccagcctggccaacatggtgaaaccccatctctactaaaaatacaaaaattaaccaggtgtggtggtgcatgcctgtaatcccagctgctcaggaggctgaggcacaagaattgcttgaatccaggaggcagagtttgtagtgagccaagatcatgccaccacactccagcctgggcaacagactgagactctgtctcaaaaaataataatactaataaggggaaaaaagaaacaggtgaaattcattgtaatatgtcttatttaaccgaatctgtctacacattatttcaaacgtaatcgatctaggttttattaagacagtttccccttgttttcctactaagcctgggaaaactggtatgtgttccacactcacagtatggctcagggcgaaccagccacatttcgggtgcttaggggccacatactgcagtaatgtaaaaccctggcttcctctaatcatgagaacctaaaacataactctgatctggccccactgtaataattcatgcttgtagttctcactcacagactttacagaacttaccgctgctcaagactctttcccacggcattaacaattatatttgggtgacatgtcaagaagttaagctgcccgggcctggagttaacagattttcacagaattgtgtacaacttatctggtccatcagatcgtctctctggggcttgtccaccattaaactagacccctggggtttcttaatttaaaatcctcataaccctttaacttgaaaactcactgtctttgcaatgacatgtggttaactctgtagtagccacataaacatctcctcattcttaaacaggagacttccattttgacctaatctgagattattctgaattatttctgccctagtcacatgtacgctacagacatgagattacacagaataatcaactgaggtggtgcctacacaatcttttgtttttttgttttgagacaaagtcccgctctgtcgcctaggctggagtgcagtggcaccatcttccctcactgcaacctccgcctctcaggttcccaggttcaagcaattctcctgcctcagcctcctgagtagctgggattataggcacatgccgccacacccggctaatttttgtatttttagtagatacagggtttcgcatgttggccaggctggtctcgaactcctgacctcaagtgatcctcccacctcagcctcccaaagtgctgggattacaggcatgagccaacatgcctggatacctggaaaatcttaaggcacaaacaaacacaggacaaatccacaggcttgggaatcactataagcagaagaaaaatgtccacagggcataaactttggaggcatgctcacagcaaccgctaaccagaaaacttcgcaggctcagtccagatctgggcaggattggctcaggggtgacccatctatcctgagagctgtcaggaccccatcctattgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaaagcttctgcaggctcatccatccagattcagctctaagagcagggcaacccggggaaaatggaaacatacagaaaacagttcacttctggcttgtcgctttggctgcaggcaagagaaggtgtgcacagagttttgaaggaaagactggaatgggctgacactgggctttgttcccggagccccatggggacagggctggcttccgaacctagaaatgcagagagctgctctccaacaggtggagggcccacccgagtaagtatcccgggcagaagaacagagcaggcaccactgtctgtcaacaccaggctcggcatcctcccatcccccagggtccctcgacctgtccccagggcactggagagaggagggagggacgaagggcacgcggtgaaaggaaggaaggaggcgcctcttcttggcgagctgatgggtgtgagtggtgagcatgaattaaaaagccatccgggaacaatggtcttttcatatttggagcctgttctgcacaaagctcagcttgttctagtgggaggactctgctttccatttttttcctaactcatttcctagggttgtggcaatgtctggcactcggctcaacccaatagagtatcctttaactgaaggatgtgccaggcaggcctcctccttgacttcgtaagtggtggcattgagacacacaaaaagggacaacttcaggaagcttttctgtctcgacccgtgggctcccaaagagctcctgggtgtttctctgaatagctgcctaacccacagaaacacacactggatgttttcagcggccaaacacccatttccctctcaaattacgctagacatgccacacccagcagacactccaaagcctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacacccttgtgtagtcccctccccttgggagtgagcaatacatagggactcacttcttaccaacagcatgcaaatggaataggacaaatgtgataggacaccacttctgagatgaggctgcaaagaaaccgtcattttagtcatctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagatttcagtctgtccccagtcaagtcttcagatgagaccacggccccaggtaaacactttgaccttgcagcaggggacccagctacgccacagcccgattcctgacccacagaaactgtaagataataagtgcttgccattttaagctactgaacttaggggtaatctgtgatgcagcaatagataacaatacacatctccattttgcaaatgaaaagatataatggaggccaggagtgctgactcatgcctgtggtcccaacactttgggaggctgaagtgagaggatcacttcagctcagaggttcaagaccagcctgggcaagatagcaagactctgtctctacaaaattttttttaaaaaaaggttagccaagtgtggtggcacatgactgtcgtcccagctattcaggaggctgaggtggaaggatgccttgagcccgggaggtcaaggctgcagtgagccctgactgcaccaccacgcacttcagcttggacaagacagtgagacccttcaaaaaaaaaagggggggaaagaaaagaaaatatataattttggccagtaagtagcagagattctcacttaggccagactgactctctctagccaccttcctctcaccatgtggcattacctatcaagcccacattccggtccatagaccagaaaagcagcaaaactccctgggcctctctccatcctcacagatgacagagacacctaacagtcatgcccccaaataaaaggataccagattgctttggaattttagggttgaagaaagagtgaggagagaatccagtctaactttcttttacagataaagcatctgagacccacagccataaagtaacggacatggaactcaaacccccgccaggatagcacgtgactctttagggattccaggaaacttctactcaaacatgctgaacaagcttctacttctctggccaggagaactccatcagtaactctggtcttctcttttggcacaccaagattaatgctctgtggtggctggctcccctggcacttggcagcttctcctatacctgccccctaagtccttccacaaagtgacgagatagagaaggtagatcagagcgtcttctccttggttaataccagaatcgacatatcacatatcacaactgcatactgcccacccagcttatgctgaggtgtgatctaagtttgctttgaaattcagtgacatatcagaaagacagcacacacatttccatcaagacagctaacttgggcaaaggtgttctcaagtacccaaggcgattgattccacaagcttgcagatcactaagacttccactatttttacaaacacataccatagatgcttacagtaaatatcataaataattaaagctaagtagcctaaggacattttgtgaagcatctttgctgcttttttttaaattaggttctcgctaattcacaagattgaataatctccaaaaagcctccaaacacagccacaggccagtgctatttaagtgattctacatttttgcaaacttttaagcacatattttcttctcatgacaaaaagtaatagatattcactatgcggagctcagaaaacaaagtattaaaagtagcctgtacttctaccagctggaaatagccatcagtcatatgtaattctttagcttctcttctatgcatattttaaaaattaaactgaagtcctatagtccacagagttcctttcattccatttacatcactgttttcccacatttataaccaggaggcaggagttttaaatagctgcataagcatctaccatatggctgcaccacagtttaaatcaatcccctgtaagatttttcagatagtttccatttttcactattataaatgtctgttataagtgtctgtagcaaaaatctttatgtataaatttcctttgcacgactctcagggtttccttattacaaatggagttgtcaccagtcctgatccgggtattagacgtaagataattaaagggaaaaaaaaaaaaaaaccatcagacaaagactccgcccttgtgaagcttagattctagcaggggaaacaatcaaggataatacattttttgctaggcacaatggctcacacctataatcccagcactttgggaggccaaggtgggtggatcatctgaggtcaggagttcgagaccagcctggccaacatggtgagacccccccctccccaccccgccccatctcttaaaaaaaaaaaaaattagctgggagtgatggcgggcgcctgtagtcccagctactcaggaggctaaggcaggagagtcgcctgaaccagggaggcagggattgcagtaagctgagactgcactactgcactccagcctggacgaaacagcgagactccatctcaaaaaacaaacaaacaaacaaaaaggataatacatttttttaattgtatagtattttactagtggcatatggtatggtcagaaatgcagaggcagaacagagtgagggggtcaggaattcacggggggaaaagctacacatttaaataaaccttaaagtttcttgacacatactgccaaatgatcctccagaaagggtatactaatttttatacccaataaccagatcagggtatttgcttttttttttttttccacttagttcaaaaaaacaaaacaaaacaaaaaaagctcaaccttaccagtaatcaaatacgttaaaacaatgaggtctcatttggctcttcaaatgggcagcctagatttattcttcatgaattgtccatttgtgttctttgcccatttatctctttttatttttgtttaccacaataataactacataaaaacacgactttttttttttttttttttttttttaagtagagacaggtatcactatgttgcccaggctggtctcaaactcctgggctcaagcaatcctcccacctcagcctcccaaagtgctaggattactgtgcctggcctccatttttctctatctgtatgcatcaatctttttttttttttttttttttttttgagatggagtttcactctttcacccaggctggagcacagtggtgcaatctcggctcactgcaacctctgccttttggtttcaagccattctcctgcctcagcctcccaagtagctgggattacagatgcccaccatcacgcccagctagtagagatggggtttccccatgttggccaggctgttcttgaactcctgaccttgtgatgtgcctgcctcaacctcccaaagtgctgggattacaagtgtgggccactgcacctggctgtttcattcatttttaagagctctttatatattaaggatttaggacacactgtcaattccatgtgctctaaacaccttttcacagtttgtcatatgccttaaaattttgtgattagtgaccagcatgcacaattttttttaagtagactacatcaatcttttctattacaatttcttccccacaaggcttaggcctaatattcctcactgccctatattcagatcaatattaacctatattttcttctagctcttttgtgattttagttttacttttacctctccaactcacctggaatggatggtaacatatgctatgaaaaatggctctaacctaatttttccgccatttggctatctaactgtcctacaaccatttattgcataattttataatacgagaggcagtgaagtgcagtgatagagatcactggttttgctgtcagttacatcagtgtccaagtctggctgactttgagcctgttacttaaactccctgagcttcggtttccttcactataaaatgaactattagtaatgtattagtagtatccaattcatctggtttttatgaggattaaataagttcatataaagtcttggtctggtgcagtggctcacgtcttataatgccagcactttgggaggccaaggcgggaagataatgaggccatgagtttgagaccagcctggccaacaatggtgaaacccagtctctactaaaaatacaaaaattagctgggcatggtggcgcacacctgtagccccagttacttgagagactgaggcaggagaactgcttgagcctggcagacaaaggttacagtgagccaagatcgtgccactgcactccagcctaggtgagggaacaagactctgtctcaaaaaaagaaaaaagttggctgcgcaccatgggtcacgcctgtaatcccagcactttgggaggccgaggcgggcagattacgagaacaggagatggagaccatcctagctaacacagggaaatcccgtctctactaaaaatacaaattagccgggcgtggtggccggcgcctgtagtcccagctactcgggaggctgaggcagaagaatggcgtgaacccgggaggcagagcttgcagtgagctgagattgtgtcactgaactccagcctaggcaacagagcgagactccgtctcaaaaaaaaaaaaggtcttcagcataatgcttggcacttagaagttctgaagcgttatgtgagctgttactctgattcctctcacttaacatgaaatacaacctttaccagacacatttctatttgattccatcccactgagtgatctctatattttctaaccagtttttcccagtatatgagaaagctaattatcttttaaaatgttacgttgtaactgaactccttaattaaatttaaatgtgtcttgggccactaggaagacagtaacatctggaaataattttctttgtttctttttaaccattatttgactttggtttgtccatcctgaccagttcaataaggtaggaaaaagaaattagcaaattagtatattccatagtctccattgtgttcccagtttcagaatgttgcctctcatgattcatcactaagtctgagggtgttggctgcctgtttcttcattgagaagtcaatgcatcctctttcaagcttgagttttcaaaattctaagcagactaggaataagggtagaaaattaccaaatgcagtcaagtgtgacggctcaagcctataatcccagaattttgggaggccaacgcaggaggataacttgaggccaggagtttaagaccagcctggacaacatagtgagaccccaatctctatgaaaaaaaaaattaaagcccagcatggtggtgtgtgcctgtagtcccagctactcaaggtgatgcaggaagactgcttgagctggaggtcaaggctataatgagccatgattgcaccactgcactccagcctaagcaacaaaacaagacaaagaaagaaaagaaagaaaagaaaaaaaagaaagaaacgaaagaaaaggaaaggaaagggaggaaggaaagaggaaaggaaggaaaggaaggaaggtgatcaaatgtatctctcacacacatacacacagacagacagctgtcccttgctatatctcccatagatcccgaaaatctgaggatagtcaagtccctgatataaaacagcataatatgcacaacctcctgtatactttaaatcatcttttgattacttataacacctaatgcaatgtaaatgctatataaatatttgttaaactgtatcatttaaggaataatgacaagcaaaaaggctgtcgagtccacaggtcctttacatgttgagtaaagacccaattttttccccaaatatttttgatttgcagttgctggaatctacaaatgcagaacgggtgactatgaaggccaactatattatgtttttcttcttggctctacatacatgattatttcaagagaagacattctgatattaagccccttcttacatttccaggataaatcctatgtggttatgattcttttaaaatgctaaattcaatctgtgactgttttatctggcatttttgcatctccactcatgtcggaactcaatcttcagctttctttttgtgtaacctttgtgatggtgttggttcccagaattatgctagctttgtcaaatcaactgggatgctttacctctttttctattccctgaaacagtgtatttagcaggcaattatagcatccctctaagtttaaaataacttatcctttaaacttcttgcatccagagccctcctcataactgttttttgtttttgtttttttgagacggagtctcacattgtcgcccaggctggagtgcagtggtgcgatctcggctcactacaatctctgcctcccgggttcacgcaattctcctgcctcagcttcccgagtaactgggactacgggtgcccaccaccgcacccggctgattttttgtatctttagtagagactgggtttcactatgttggccagacaggtctcaactcctgacctcgtgatccacccgccgcggcctcccaaagtgctaggattacatacaggcgtgagccaccgcgcaaggccagaactttttttttaatgctcagcttcttccccagtttctgatttaaagtttcagacatccaagtcatttcccaacagccatgtcactgggattttcaaaggtgttgcattttaagttactgtgttttacattacaaaacaattacttcaaatgcaacttacatttgttacactttttctatcatatcaattcctttttagttttctgtatttggggttttctcttttctcttttcttaattaaacatgatagtgatttggtctacttccttggccttttttcccaaatagcttttagatttatcaattcagtgtttttatctgtttttctaattcattaatatcacttttatcttacaattcttttctccagctgtctttaggcttgttttatgctttccaagtttgagttgaatacttaattcatttattttcattttctttaataatgttttaaagctacaaatgtgcccctgaatataactttggtaataacccatacatttagatatacagagttctcaatatttcctaatgatcctgtaacagtaacttcatttcctctttgacccaagtgtgatttaggagaatatttttaaattttcaagtaactggatttcattaacatgtttaagtattctatggaggataaaaacatctctgaaaggagatgaaactctggcaaataaaaaaaaaccttttaaatagaaaacacgacaatgttaaaagtgaaaaatgactcatataatgctgtgatggccatatctacagacactccttgtagaagggatataaccaccattggtcctggggcactgagagatctgagtgtaagcaacacaaggagagagggaagaggatgttaagtctctgtgccttctgaaaattttatcttgggcatatgctgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaactttgtagtgccaagttaaaaagaaaagaaaaaaaaatggactccataaatcagttttccaatttacgttgaagaaatctgtttcctactttctaatttctgcaactgggaaattctgtatattatgttaccatataatgaaggatgccggtaaacagaaatccacacgcctgcacacacaacagattacattgtatgtaattgcaaacaccaccaagttatgtactcttgggagcattattagtgagatgtggttatttaatgcttcatctatttaaaaaaaaaactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaattgctggctaccaaaacctccatcccccagcagcagatggcagggccagccttttgtactttacttgaccatttaagaaactcacaaaggggccagtcatggtggctcacacctgtaattccagcactttcagaggccgacgcaggcgaatcacttgaggtcaggagttcgagacaagcctgaccaaaatggcaaaaccccgtctctagtaaaaataaaaaaattagcagggtgtggtggcgcacgcctgtaatcccagctattcaggaggctgaggcaggagaatcatttgaactcaggaagcagaggttgcagtgagccgagattgcatcactgcactccagcctgggttacagagcgagactccctctcaaagaaaaaaaaaaaaaaaaaaactcataaaggtacacagcacctgggggcttccattagcatcagaacacccacggaggcacgccccatgggaaggtggcactcagctcccaccacagagcaaggccctttaacagcgaagatgctgcagggcactgctactcgccctgctggggagaagccacccagcagccaccctaggagcctggcacagaatgcccagctgtggggaaggaaactgtgccacctgcatcgcccgtgtgccaaatggagttcaagactctgcaccgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttgggcacacgagttctactccaggagacatttacatcaagttctactctctgaccaacattgaacattttatttttattttatttttttacacagagacagagtcttgctctgtcacccaggctggagtgcactggcatggtcatagttcactgcagcctcgaactcctgggctcaagtgatcctcccaagtctacctcccgagtagctaggactacaggtgtgcaccaccgcactgggttaattttttgtttgttttattttgtgagacagggtctcactcttgtcatccaggctggactggagtacagtggcgtgatcttggctcactgcaacctcgacctcccgggtttaagcgattctcccacctcagcctccccagtagctgggactacaggcatgcaccaccacaccgggctaatttttgtattttttggtagagacggggtttcaccacgttggccaggctggtctcaaactcctgacctcaggtcgatccgcctgcctcagcctcccaatgtgctgggattacagacctgaaccacttcacctggccctggctaatttttttttttttaattttttgtagatatggggtttccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaactcaattcggtgggatacctttttttatcttggtgttatttgggtattctgcactaattctggggcaccaggtaagtttctatcgaggggtagaagctgacttctgtccccgtcccccaagaccaaagaggaagcctcttctgccaccactgaaatactatctttagaggaaggcatgctattagctcatcaagcacaaaacacattcgagctaaacattacagtcaaatgtcacagccacttcaaaatagaggtacccaaaaaggcagtcagtcttctcagcagggctttgaaaccactgccaactgagaacttgatctcaagtcttccaacaccaaaacacctggtggaataggtacaactaacgggcagacagcctcaaactccattcagctccacagcgcctctccatgaccactgcagctcaacctctgtgctgggaagtgcatgcataggatggagccatgtttctagaaccatcagagacaaattttctactacaagtgatactgcacatgacagtttattccttggctggcctctgatagtatgcatttgaaccatatggaatcaccattttttttattaaattagagctgttaaataataacatcatggaggaatgtgttaggttctgggcaaggatcttaaatacacagttttggaacaagtgtagggaggggcccaagcccacggccggtgcccaacggtggctacacactacagcagcaaccggccttcatcctccaagtcctccttggaatttgggtgaaactacttatatcttaatctaggcagctggagatgaagacaaagacaaaagagaagaggagagaaaaggaaaataatttgatagaagtattttccatcccaaattttgagatcctggcacgaatgatataatctagatacccaacaacctatacttgttccaaaatcgtgctgttaagatccttgcccagaacctaacacgttcttccatgatgttattaacaactctaatttaatccaaaaatggtgattccatatggttcaaatacatagtatcagaggccagccaaggaatgaattgtcatttgcaatatctcttgtagcagaaaatgtatccatgctggttctagaaacatagctccatcctatgcacacacttcccccaggactcctggactgccaaaggcagcctataagccatcaactagcaactggacatttcatctgggcgctcaggaggtacagacctaccaatcacgggagtgaaggtacccaggccaaggggctgtacaagaagggcagagaggaggccaccatcctgaacacatcacagactgcccatctgtgcccttcaagtgacctctaaagtgtggtatcaatctccactgaacctttgctcttattcccacaacacttggattctttctttacagggacccatgtgaaaactctttatttttttattattattatttttgagacagggtcttgctctgtcgcccaggttggagtgcagtagtacgatgttggctcactgcaacctctgcctccctggctcaagcgatcctcccacctcagcctcccaagtaactgggaccacaggcgtgtgccaccacacccagctaatttttctattttttgtggagacagggttttgccatgttgcccaggctggtctcaaacttccaggctcaagtgatctgcctgccttggcctcccaaagtgctgggagtacaggcctgaaccacggtgcctggccaaaaaccctttataaacactctcttttatttttctctcaagtatgactctttgggcctcaccaaaatacaatttcacaaaataatgtcacattatttgggggaggggagaggccaccaaatttcatctcgaagcctcttccctcatttccaaggaaataggcattgttggaacaggtaaggctgtaatatttggtttagctttgccctcctgagccacctacctctagaggcacgtgggggtctctttctttgccaactgcaccaattcctccacaggaccgtgcagtagctgaataacaacccccgaagacgcccacatcctaatatccgtaacctacaaatatgttaccttctacagcaaaggaaactttgcagatgcgatcaagtgaaggatctttggatagaggagatgatcgtggattatccagggggcctgatgcaatcacaggggtccttacaacaggggcaaaggagaggacagagtcaggcagaagaaggagatgtaacagaagcatgacacagagtgatgtgaggaaggggccatcaacccagaaatgtgggggcctccagaacctagaccatgcaaggaaatgggttcctcctcgaaaccgctacgagaaagcagccctgccaacaccctgacttcagcctactgaaactgatttcagacttctaggctccagctacaaggcaatcagtttgcggttttttgcatttttttttttttttggaaaaatgaaagctgatttttattttatcatcaacagccattctttagacatgaacatgcatacgtaatattctatgcacacatcgcagttttgaacattagttaataaagtttaaacatactacatccttacagaaaacatcaaaatgcaaacttaagtttgtgttttacaccaacaagtttgtggtaatttcttcttcttttttttttttttttttttttttttttgagacacagtctcgctctgtcaccaggctggagtgcagtggtgcgatcttaactcactgcaacctccgactccctgcttcaagcgattctctgcctcagcctcctgagtagctgggattacaggcaggcaccaccatgcccggctaatttttgtatttttagtagagaaggggtttcaccatgtcttgatctcctgacctcatgatccacctgcctcggcctcccaaagtgctgggattacaggcatgagccaccatgtccggcctatgtggtaacttcttacggcatcaagaggaaactagtatagccatctggagaaagggggacagaaccactggacacacagaagcaggggtgtccctgaagggttcaccctaccaaggggttcacactaccctccttctccagaccctagggaccagctgaaacctctctttctccatcaccaaaaattaggaccaaaggcctcagatgctgtaatcaagagctgtgtcttttttttttttttttttttttttgagatagggtctcactctgtctctcaagctggagtgcagtggtgcaatctcaactcactgtaccctctacctcccgggctgaagtgatcctcccacctcagcctcctgagtagctgggactacagacgcctaccaccgtgcacagctagcttttgtatttcttgtagagacagggttttgctgtgttgcccaggttggtctctaactcctgggttcaagtgatccacccacttcagcctccataagtgctgggattacaggcgtgagccaccacaccggccacgagggctatgtcttaggagaggtgttcagtggagtatcttagcattagacagaaaaaacctcccatcctggcctaccgcatttgagatttataaatatccaaattaaccaaggaaacaacagaaaaacagtagttggacaaagagtttgtgtgtgctacatgtttattttatctaataggagacaccgaactagaaacatctacattcaagaagaatccctggatccacagttccttttatcaattcacaaaagccaggccgagccaaccttacccaatatattccacaggtgggcccgcctgaagcctcgctgtgatgccaggcagccagcctgaagaactggaaagccagggcccgtgcacgctgggctcctgaagacaaaggaaacagaatggctcgggaaggccgtggcaccctgcccgcctccgtggtagcctggggccactggatcttgctgtctccgcagcacctgagaggtgtgagccaggcagccaaccacatcagaagctggctgccggctgccccaattgcacaacacctccaggggagccagctttccaggactgggttttacacaccatacgggcactggccatgttgacccagtcaaggcatggcaccttgaagaatggcccacgcaaagaccggccatatggacagaaggcatcctgccacagagcgatttctgaatcacctctatgcaaagaatagtcttctctcttacgcaaaggagatcccatcaccaccatctcatttctatcccaggctcctccagttctctttcaatcacaagccagactacccaaccacttaactctctaggcccagatatgacttaattctcccactcctgcatgtttgttgccacttccccattttgtgttaacaattaacctgaagtattatgttaacaattaacatgaattgtgttttggtttttaaggtcggagtaactaggattactcaataggatttaaatgttcaattttagcacacatgtacaaggcgctactttgtacatgacaagatgaagtggtttaaaaaaaaaacaaaacataaccacctttcacaaagggttctcattcagcctcctgcttgtgaaagatacgactttgaatagtgaaagtcccaagaagggtaattcaagcaaaactggtttctagtttgccttgattcaaattctttatgctacttgacccatttctcttttcctcttgcttctcctgatgcctctcaaaataataataaaccaaccccagaaatagaatcctgtcttccttagatgtcaccatatgactaatttatggcctttgtttaaagcccttacaccagagttgactccagtaatttcctcctcttctatttgaatgtccatttacagcctctctgtaacctctgggtgaactgagaatgttctctgtgcctctcatgatgtggattcgcaccctggtgacagcagagtggctccgagcagaatctccccattacagctgaagcccactgggaccctacccaagttcacgtgtatatcccaagagagtttgctgaacactccttatgccttaatgcacctttgaaaaaaaaaagactaagggggctgggcgcagtggttcatgcctataatcccagcactttgggaggccaaggtggaaggttcacttgagcccaagatttcaagaccagactaggcaatatggcaagacctcatctctacaaaaataaaaataaatcagccaggcgtgggggcatgtgcctgtggttccagctgcttgggggtgctgaggcaggaagatcacctccctcagccttgggaggttgaggctgcatggagctgtgattgtgccactgcaatccagactgagcaacactgcaagactcccatctcgaaaaaaaaaaaaaaggcaaaaagatatcaaaggctgagtgggcaatttgaatgtgttcccaagacgtgatgggaattttctacgtttggattcaggggagtggggtcttagttttgctctcattcagggaggtgggtcccaaaaaatatcccctgttggccttaggaggaggaatacttgaaaggtatatctgaaaatgctccaagttttttcctgccccgctttccagtggtgcccttcgccaagtcatgaaaactctgccaacactgttctctctccagcactcacctgggctccccaccaatgtcttggctgccgtcacgactaaataatgccttctcttcttcccctccacccacccctctctggtctttagcacaacctatcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctggactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcctgggctcaagcaatcctcctgccttggcctcccaaagtgctgggatgacaggcgtgagcatacacgcctggccatggttttgatcttataaaataaattaactctaaggccgggtgtggtggctcacgcctgtcatcccaacactttgggaggctgaacggggtagatcatgaggtcaagagatcgagaccatcctggccaacatggtgaaaccccgtctctactaaaaccacaaaaaattacctgggcattagcctgtagtcccagctacttgggaggctgaggcaggaggatcgcttgaacccaggaggcagagactgcagtgagccaaaatcacaccactgcactccagcctggcgacagagtgagactccatctcaaaaataaaataaaataaaataactctaaataataaatggcaagaattttctttaattggcattttgtggggattcaccccaggcttggctgtgtgttatcatactctcttcactctgagaatctgaactgtctccctgaaggactgaagctagcctctgtatagtctaaatgctaaaactggctgtcagtttcctcaatgcttgccactgtgattttattctgaaagctacagctcttctcattcaaaggttaccctccctcctaaccaacccagaaagaactcactacccagctctgcttgcaccctagtgttggggctcaagcttccggttccgctaagactctgacctcgcttctaaggacacacacctcagaggcccagagctccgctgtatcacacactcattgtcacatccctcgatgcatcattcccagaatcctcaaggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcagaaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcgtgtgtgtgtgtgtgtgtgtgtgtgcgtgtgcgtgtgcgtgtctgcacgcgcacctgagtgcacatgggctgcctggtttacaggccaccacaacccttccaccaagtgtgaacacacatacacttccttaccaaggtgcccaccggaaacccctgcctggacccctgcagccctcccagccacactgcagcatcgagggaacagcactttgcctccccaaacctgccctggctactgggtgaccccgctctgctatccccaccttcaccctgagatgcacagactgtctgctctaaagggcatgaacctggagattgtgagtcatcacgacgcgcaggaagcaacgtctcagtccaaaccctgagcccgttcctagagagccttctccgctctctcacccctcatcccacgtagagcaatcagggctcacccgcccccttccctttctctatggcttcttcaagatctcctcatccatctgcccacaactggaactgtttatttgtttagcccactggtaagaaaaatgagagagcgggctggcattcctggctgggcataaacacgtttttaaaaaatgtctgttccaactctgtctgggtcccgtactgagccctttaacctcctgcaagcaccatggagacattccatgggaactatcaccattcgttatcatcgctgaaagacaaaatccactgtaccctgcaacatctcacacagatccttcacattcttggtttgagagctgactatgcaagaaaaaggaagcaccatgactgtgggaaaggccactgtcaccaggacaagaggcaccagcaagagccctgcatcaattactctacagaggcaccgggaggcctgattttaattttttaaaaatacatttaatgaatcacatacgcaaactttacattggcagaacactcccttaggatcatgagcaaatttctgatcagatcaaatagcaaactgcccaaggaaaccacgaagaggggtgatgttgctatcacactatcaaaaagtaaagacatacttctgatttctcacaagaaatttcccaacaaaagctctctgtcttagattccgaaagaaaaacatcccccacacagagtgtaagggccaagaatggcctcaccatatgggacagcttctgaaatacacagaaaacgggcaacgcgggacccatgggacaaaccactgtgtagccagctgccccggccaggcccgtggtgttgactttggcagtgcttgtcgaccatgactcagcaatagtcatcgaaactgaaatcaagtggaactgatcagttcagacctccaatgttgagtttgactcaacgattcttcaatgcccctggtcttcctgaaattctccatttaaatatttactggtttaagggtaaagtcagggaggcacgggcatggttgttggaccttttctgtcttatcctattcaaatctggctgaactgagtaaaacgttatgcagcaggatgtcttcctatataatccacttcatcccgcccccccaatactcttccataggggttcaaatgcagatctgaaccaactgctcgatgatcccccaaagccatttagtctctgagcttttctcatctacaaaatgagatgtgtccccactctgcataccgtatagagcacctgcaaggattagttgaaagggtataggcccaaggactttgaaaaatgaagctccttaaattattttcccgatgtcctcagacagacttggcaccttacccttttactcataattaaagatttgagcagctaactcagaggcctaattgtgatgctaagtagacatatagtggctcaataaaaggaaagactgaaggggtttagagcagcgaggaaagacaatcgaggaaacggggctcgaggttctgggacgagggcctgctgagctggccagcccagccaaggccacagggatacagtccttccagtcactcaagttaaaaatcttgcagtcacccttgactctatgtcctgtcttgtcccatatctcccttcaaaatctatccagaggataagcacctggagcagatcgaatagcatccctcctagaactcatgtctaccaagaacctcagaacatggccttatttggaaatagagtctttgaagtaatttataactaaattgagctcagactagatcggggtaggccttaaatcaatgactgagccaggtgtggtggctcacacctataataccatcactttgggaggctgaggtgggtagatcacctgaggtcaggagtttgagaccagcctggccaacatagtgaaaccctgtctctactaaaaatacaaaaattagccaggtgtggtggcgggcacctataatcccggctactcaggaggctgaggcaggagaatcacttgaacctgggaggtggaggttgcagtgagccaagatcatgccactgcactccagcctgggtgacaaagcgagactccatctcaaaaaaaaaaaaaaaaaaaaaaatcaatgactggtacccttagaagaggagggaacacacagaaatgcacacaaggaagacagccacgtgtagacgggaggcagaggctggagtgacacagctccaagctaaggaatgagtctttactcaaatgtcaccttctccgaaagcctttcttcactgtgtccaccgaacctgccaactactgctcaccccctgccctcgtcccgcctcctctccacagcatttaacatcatccaaaatactataatgcacttagtaatgatgtccagtgagggagatgaggtagtataagctccaagcagacaagcatttctctctttttttgcccccattggagtatcaccggcaccaacaacagtgtctggcacacatgggactctcaaacaaaaggtcaagggcagcccagggaagccccaaggctggaagctctcgctgagaaagccaggctgggagaagcccgtctccctgagtcaggcctgcaagccaggcaggcagatggtgaaaggcaggagggagaggagccactgcaggcccctggtcagcagaacaagaagaatacggagccgggagtttgagggcagcaccactgatattcaggctgtgtcattcttcgttggggatgagggtggctgtcctgggcatcgcaggatgtttaggagcatccctggcctctacactggatgccagtagcatcctctccccaaagtgtgacaaccaagaatgtctccagactgccaaatcttggggggaggaagcaaaatcaccccctacggagaaccgctgaaactgagtttcagtccaatgacggcccacatgccacgatcccagacagcacagggccaagcaggtaacacaaatgagcgaagttggctgggaaacaggacgtggtagggtaagagctggtaagcaacagtgagctctggcaacctaaaaagtagatgttccttccacaaggggcagtcaccaccctgttctagccaggttttgccctgaagacccaaaatggccaaatcccccgattttttttttcaagagaaggttttaatactgatttttctgtgaaatgtgcccatgtttaaaacatagtatgtggccaggtgcagtgtctcacgcctgtaatcccagcactctggaaggccgaggcgggcagatcacttgaggtcaggagttcgaggccaacctggccaacatggcaaaaccccatctctactaaaaataaaaaattagcctggcgtggtggcccatgcctatgattccagctactcaggagcctcaggcaggagaatcgcttgaacctcggaggcagaggctgcagtgagctgagatcgcactgctgcactccagcctggcgacagagcaagactctgtctcaagaataaataaataaataaaataaaatatagtatttgctgaacaaaacacatctacaggctaggttttgcctacaagctaagactgtgcaacctccgcacagagactgcctggaggtggaaggggctggagggaaaccccccttaggagcctgctgtcatctagacacaaggggcctggagcaggcctgtgagggtaaggggcggagggaggaaaggctggatcccagaaactcttaaggtgaataagataagcacagcaagacaagtgtgcacactgtaatcataagccacgagggccaaagcaacagccaatgcccccggctccctcccacgatgcgctacaggcagcactgtgcttacgcaggtcacacacctaggagccggaagacccctaatgcatccttcaggtaggaccctctgctttgcagaaaaccagcgcttagaaaaggcttaaagtgagtattttgaagacggctggaatcagagctcaaatccataacctcaaaggcttcatgtcatcttgccaccacccacgccaatccttgagcctagagtaacgaagagaaaggctgcaacgaccacacacaccacgacgtcagcccaaaggccacgtggctccatccacggcaacaaaatgcaagggagctccgagggacacttccgtttcaggacaggcttacggggaggacaccagctcctcccaccctatctgtagactgggtagaagggcttcttttgagcgctctgtcttcccagagaaggacgtcctggaaacaaggcacgtgcagtattaccattaaacaacatgcacatgccagtggcgctaaataaacagcagagacagaggctgcctcacccacttgctccatagtctgcatcgaatcaaggtcactggagacaaggtaaagtccacagagccccctcatctcacatccacacagctttgctcctcctgaaagaaatgaaatagctggagtgttttggcaaagaaacgaagaggcaggtgagcaaggagagatgggggaagggaggggcgaaagaagagaagaggcagccccatctcccagctggggagaaacttccagatgggaggcagcagacgccactgaattgatggccagtctccaccaagcctcatcatgccccgcaggcaaagtctccactccccttccttcccccagccacgggcaggaggcaccacccatgaagactgagtctgagatcatgcaccattgactacccaagcccaattcttcctgtccctgatctccaagtggtagctgcaaataagcccacgtgagttgcactgaaaggatcagggcactggttctcgaggactgggaatgcaatgataaaacgaaatctcaccagcactcagtaaagccagatccaatggcagccttgggctggtcacccctaaaccgccatgtgtcagtcgggttccgcctcccagaagcgggttaccctgatttgtgagctgattattctagaagactccagggtctgaaagtatctcaacaggttggctatgtaaaaacacagtcaatcaagcagccagacactttgcagagagactccactccacgaagaattacaggaggaccagagggtctggctgtgccggatcccacagctcagcggctacatgtcccccagaaggtgggcccaggaaggccctgcaccttgtatgggaagctctctactccccaacacaatacccctcggccttgactgccccttagacaccgcctgcctcctggagacgagacattcctcagccctctcccacatatgatctccgcatgtatccattataaggatctaacttttttatggagaggagaaagttcccacatgcagaagacttacaccgcagggggaacgaagggagggtcatttagcacttgttgaaagaagatgagtatgagagcaattgggaggagaagaaaatgtcatgtcagctatgaaagttaaacaggaacgttcccctccccacaacgaccgccctgcaccgccctgccccaagtccttcccaatgcggcggcagccaccagcccatgcaggactcacacatgggcagacacccaagttaagagagggggcccgggaaggggagggacaccatggtggtttgcagagctccacctctgggaatggatttgatgtcaagtgtcagcaagtaaattgctattggcttctcaataagcagcagcagtgagttaagtgtttccccgtattgtggagccctcacggactcgatacagcagtattgacagcacaatcacacagtaatccagggtcctctaatgcctacacttcctcaatgaaaatacactttccacttggacatcagcccattagctttgggctggaatctctggcctccttatccctcccccaggcacccctgggctgcaggtctggcatctggccccctgacaccccagccaacatgaacatcccagccagagtattgtcagggcccaaccgaaaaagataaacagtcagagacctacaggaaaaggcctgctctccctgtctataaatcactggtgggaaggaaagaaaagtgatccaactctttcaggataaaaatcacagcagtcactgaggaaaattgatgttcccttgcaaagcgaaagatgttctctccgggaagatgcatgccttcaagttttcagacagactgagactcaaacttcacccaatgtgacacaggattgagacaagttatgtgacctccacaaagctcaacctctcacgccagattcgatgcttcccaaaaggaacacacccatgtcttggcagtctccgataggctgaaatagtagagggtctgctgggcacagtggctcacgcttgtaatccgagcacttagggaagcagaggtgggtggatcccatgaggtcaggagttcgagaatagcctggccaacatggcaaaaccccatctctacaaaaaatacaaaaaaaaaaaaaaaaaaaaaaaaaaaaaagccaggtgtggtggcaggcgcctgtaatcccagcaacttgggagggaggctgaggcaggagaactgcttgaacccaggaggcggaggttgcagtgagccgagatcacaccactgcactccaggctggggggcagagcaagactctgtctcaaaaacaaaaacagaaaggccagtcatagtggctcacgcctgtaatcccaacactttgggaggccaaggcgggtggatcacctgaggttaggagttcgagaccagcctgaccaacatggtgaaaccctgtctctactaaatacaaaaaattagctaggcatggtggcaggcacctgtaatcccagctacttggaaggctgaggcaggagaactacttgaacctgggaggtggaggttgcagtgagccgagattgtgccatgccattgcactctagcccggcaacaagagcaaaactgcctcaaaaaaaaaaaaaaaaaaaaaacacatagtaaagggtctgctcatttaatagtaaacactttgcaaatgcaagctatgtttcaaaaccatttctcatccatttttatttgactcccagcacaccctggaatcgctgggggagaagattttattccagagaccagtgaaacacaggtaaaggagaactaacgtgacttacccaaggtcacacagctagttagcagtagatttggagctagagcctagactagggttggcaaacttttcccataaagagccatgtaactatttcaggccttgcaggccacgcattctcactgcaactactcacctacaccacatgatagcatgaaagtggtcacagacaaaacacaaacaagcaagtgctgctgtttgccaatgaacatttaggaacacaaatataaatgtcacatattgtcagatgtcccataatcgtattcatcttctgattctccaccagccatttacaaatgtaaaagccattcttggttggcaggccatgccaacatgtgttgggtcggaactggcccgcagactagagtttgccaatcccagattgctgggagacttctcaatatctactaatagaataccacaaagccaaaaaaagacaaaccgtgatcattcccaggcttattacaattttaactctccagtccagtcaaaattgcttgcctagcaaacaccaaacgtaacccaggctccaggtatctgacagcaatacagcttgcgcatgcaggcggggtgttcaaacttctctagaaaacaatgcctttttatgggaatgcctttttatgggaatttttgcacaaaatttcaagttaagaaactttccataaatacacaacgcatgctctagccacagctggtttcatatgctaactgcagaaggcatttccgaaagcagcatgtgaagagtcctccttaaatacagcgttagggaaaatgacaccctctatcctccccactgcccccaccaccaagaaggaatttgggtctgtgttcagtaagaagaaatctggccagaaaggggttaatgcccttccaggctgggatctgataaatggctgtgcagaaagcaggttccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgggacccgggcgctcagctgcgctcgctccgcttggggcgcgggccttggggcaggccgggggtcccgcgcacccgcctggggccaggaaccctcgccgctcggcctgcgccgccccgggaaccggccccggcgggaacaaagcccaggccctcccggaggcgctgacccctcgctcatcaaaggtcaggggccggcctagaatcgggcgagaagaaagggacgcgccctcggccactaaaaggagcctgaggcctccgaaccggagccatcgctccctgggccccgtccacgtcacagccaggccactcaagcatggggacaggagccaatgtggacaggaatttattggaaacacacacccatcctattaactgctttacagagcacttctgtttttcagttgcagaaacttataaaaacatccccctgctctccgttgagagtttaaggatagtttttgaggccagagaaagagaaaaggagagatcactagaaagataggaagaaaagaagtgggaagaaaaggagatgcagtctaccatgtaagcctccaggctccttagcctcaccttataaagccacatcaccgcagagatagcaaagatcgtgccctttcccagggagttcctaccgccagggtaagatttaaagcggccaccccagttggtcaaagtgattgctgggcgcctttctatctccccaagttcaccttttccagttggtcaaagcgattgctgggcgccttctatctccccaagtccacctttttccattctcatctgaaagccagccccaaagaaatctcaccggaagtcctctgtcctccctgtcagaatcccaccctcagtctgaatttactcccgattctcacagcacagaaaggcacctgcttttaccctttctgaaaaccacccacccaggctggccttacagcctggagagtcttttcctcgggcacaataatgaaccatgcaagtgttagaaatataatcagctcatgaggcgaagagcagtatgtatggaattgtattagcatgaggcacacactgactcgggagaaaaagggatgcttagctggtgaaaaccatcacatccccgtatagaaggctttttgcacaatgtaagttgggttcagattaatgtaagtatctaacctgttgggtacagacagcccctttctacattttagtccagaatagattctggggaaatttatttatttatttatttatttcagctaaggccctgggagaaaagactgcctccagggaatcatgtccgattagggacaaaggagggcacaagcccaattcagtcacacgtgagagcacgggggccgggtggggggagttaagagccaacagggaaggtggaggatgagtttgcaaaccagactatggtcactgcagagctgcttccagaccacctgacttcaggcccaagaacaggtggtgttttcaaaacacactgttatttatattggccatataagttgagaacaccttaaagaaaacaattaataatttaattgaaaaagtgactatgaataagacatgaagatgacgtatgctagcaggaccgcaagcaacgtggcccacaacgcagagatgcctctggcaatctctccggaaaaacgaagattccttacctgggataggtaaggcctgctggataaattaaagacaacaagaaaatgttgatactctcagaaaatctaattttgctgctttatcttcatttttattaacaggggacaacctcgtaatctggtgacatcatgatcctggtaggcccacagacaaataccttcaataaaataaaagctagaaagcccaaagaacaagctattaaagtaacctgggaggatgcagcactgcctgggcagaaggcccggacgggatctgccctaatactgccactgtcccaagaggcagaccctgcaacctgcctcctgcacttgagaggcctgacaagtagaactgagagtgaccctgagttccttttctttatctggcaccagctacacacatgatgaggcctagtcaagcctgcctttgttccaggcaaaaatttaacaggtaatccacaggcaggtgatctatggcctctgtacattatggaaatgagggactacacacaagctgggtgtcacctctactaaaactcattttccttattcataaaaacaatacctcttcagagggaattggcaacttctgcacttacatatgaaatcaggagttcctctgaaatactccttgcaaattctatcctccagctctggaagccctggctcttcggagggcagctgcctgatgttaaacccatggcctacccagcagtgacagcctgacattctcatcgctccatcctgaacactgctgacaaataaacccactctcagaaaaggcaattcttccctcgcagttctccatacccagtctcgtctcatctggaaagcgtaattggcaacagccgaaaggataaatatttaaaaataaatcagggagcgctaaccccttccctactcctccccttacccactctccaagccagaggcctgccccctaacgctgagctggctggtaaattacaatgattctaccgagccaaacctgcttgtctctctctttctctacacatacacacttactaatgctgtatccttccacttttgcaaaggtaaatatgatctctaagatacagtggatgtcagcattctgacttccagcgtaacctgggctctcttttcacagtacagcgggtttagacagatttgtgcacccttccgggttcttctatttttattaaattatacgtatacattgatttttaaaactagtgcttaaataacccggaggctttaacaaagaaaaatccagaagagggcaagaaacaaaaacaaacgttcctgaaataaacaaggaaccatttggagctgaattggcctgagttcaccccatgattttgaggcagttatatttaggggcctggtacccgctgggtggccgagccctcctgggtatggaacagaatgcagaagttcctcagaacagctcacatttgccttcataaccattggaagctggtgtgccaaggcctgcacacagatgttttgattcacatttttctgctgaagcctcaaggcctccatccatccctacagtgctaattccatagattaatttttacccccaaatcgtaggtggaacattatctaatttccttacccaccctccccagctcaggtgctaaatctgtcaatgatatcccacaacaaagatacaaatgagtaaccattttttaaaagctgtgatttcggagagtttttctaaattaattttaagttacaaagccccaagttttaagaaagccaaaatacagaagttgccttaaaacagctttacatgttaggtaaagagctctctctctctttctcgctccttcttttttaaacaaaaatattatttctgaaagggcaaagggaatttgccatgcaagacttttaaacacagggggattcttacatttgtgtttctaaaccttgaaattgagaattttaatgaaaaggcggacagatgcttaaggacagcatcgcaatctgggtccatacattacaggagagagaggcgctttgtttggggccaagtaaaaagaggtgggctcctattttgttcataggccattcccaccgtctgacacatccctttacagtcggtctgatgctaaccactgaattcttggaggggaagcaggttggaaggagaagaaaggaaaagggaaacagaagaggaaaagaaatgggcgatgggatactgcctgtttatacaaattgtagatttaaaaaaaaaaatcccaacacggtatccattccatagtatgtaccaaaagcactttcacacgtgagttaaaacgatccattaaatgctatatcgaaagtacaacaaccagggttggagtttattttttttttttaatgaagaattcattgaggtttgcagttctcccctattaagcttctaaggatggggcacaaggcaggaagatagacaaaagatgacctttttcacgctttcccccaaataattctagaatcctattttcctatcttttcattttagggcatttgggttcaaaaatctgtgctaatctgacttcagagcccccgagctgaaaaattcacatatcctccaagtcagccagtgttttagaatttggatttctattgaggctgttccaatcgccagtgaggcctacggtaaaaacgtgcttcatgctgtttcgtttgtctctctgcagacaaatagaaactgtgaaatttaaagaatggatgaaaaaaagaagtctaaaacaaagaggttaaaaaaataggacaaatgtttttgcttttctgtctccccggagcaattgtgtggggaagtctgcattgacaataaccatgagaaggccatctaaaggcgatgcgtacacaaggggactccttccctgctgcctttggtctgggagaaaaagtaccttagctccgttctccagaaacaaaaggccagggccacggaaggggggagaggtgacaggggctttcacatggagccaagtgtcaatgctggttcatttttcacccgtcttacttggaaagcggctcagggaacttcctaatgactgctttttccctctctccctattatttctaaacctaaaagaacaaaacaataattttttttttaacctaaaacccatcattctattagaggaaagcctttggggcctatgcagtcagattttcctctttcctttcctcatcctgcttttcttttcttttttggaggggggttccaattgtagatcacatggaaataagagacactggacactatagtcatttttagtgacaccagaacggcctttatatctacgaaaaggcaggaaacggggagaaacacacatgcacaaacaacccaacagggatggaaggcggtggtggggaggctgcgggggcaaggccttgaaacactttctttttttcacagcatgaggtccactaatgccagcttcagatttgcaactgaatcaaagtctccgagtcgtcattacaaggtttttcggtgggtgggggcatggagaagtggacaataaggatgtattaaagacacagacaaggtgtggcaggggcaaagtggggggaggtgttacaaagaaaggaagctgagatgaatcactgcgtgccatgaaaataccagggcgagtggatgtcggagtgtttaaccagatttgaagctggaagcatcttccccagcgggcaaaccctaggacgaggcacagccacgcgaccctcagcctttgaacccagacctggcagcttaggagcacactcccccttccccaggcagccacaggctctgagctgaaaggcaaggcgggggtagggataagagggccctgcaaagaagcacaatcaacaactcaaatatgaacggaaatgacgtcagcaaagtgaaggacctgtttactgcagatcaaaacaaaacaaacttccaaaccttttgtgtacacaagaaaactctataaaaagccttcctaaaatgtcaccagggtcgacacatcagcagccccacaagaaaacgcatgacagttaccatggagggaggggggaggaaaggggctgaagggaagatgatctggggggctggggggaggagtgataaaaccagaaggagcccaaaacccagttactactgccccctctgctgatccttaatatttattggtgtttataatctaaaagccatgctccacgtttcacttaatacaaggccagacagtgttgtctaatgaggtagcattacaatcagcttgtaatactgaatttttaatgctgccaaggattctgttacataataatatgaaaaacagaagctgaaagtgggctcgcaggggacaggacattcgaggttccaggcaggcgagcgccaccagcccggttcccctcccccacacccgcccccctactttctgacgtgcaatcaaccctccatcccgatacaggaggtcggtatggaaaccaggaggattttttttttttttttttttttttttaggaaatccacacttttcattattattgttattatactctcatccgaagtttatagctcaagagtttgaattctagcttttctggggttaaaggtctaaaatgaaaattaatttttttggaagaggtggcgaagagacaatacaggggaagagaggggtagcttattttaagcaaaccaagaaatttgggagaaaaatcacagagggagaaagaacttggtgggggagggaatagatgtctgccgaccatattcacagctgccgcactcagtttacattggtgtaatttaaaggcatatatatagccgccgttgctcctctctgtaataccccaagactgtaaatctataaccactgcaatgatttagtgattaaaaacatgataacatattgtgtaactgcaaaccacagaacccctgccaactctctctctctaagataaaggggaaaaaaatacagaaaatgtgttgcttgcagccatcttcctaaacccaaaagattttaataaaagaacctatacagcagacgaattggaaaggggtgagtgaattctgtgtgaagccagcaaagggagagaaaaaaaaaaaaggcagctttatgtgggattcttttccttgtactaacaaattacgacctaaacatgccttttcttttctctctctttttttttttaatagtttgttgtaactggaataactggtcttgtgcactgtcttgcatattcaaagctgctttgtaaccggatctagagacccaaccttatttgcctgaactcaatagggtttttttctccccctcctcccgggttttgttttggattcggtattgtgggttttctgttgttgctgggagcctatgtctatgcaggcataggctctggtgcctttaaaccacagaccaaacacctgaaagggggaggcacaatttgtacaatggcaggaggagcctaaaatatacaccaaaaaataaaatcaaagcagctgtaggggttttggcctctgagcagctgacctgaccccgttctgtatattcttttatttccccattgcaggattcctgcaccttgggtcagattcaaactcaatgtgaccctgaggagaaggcagtcacagagtcctgaaaagctgctccatatttaataggggtgggggaagtaagtgcatatgcatccagactcccccagtgaagacacccacacggtgcagacgtacgcgcgcgcgcgcgcgcgcgcacacacacacacacacacacacatacacacacacacacgtcaggactgccaggccatgggaccagctccaccccagttttcttggcccacaccactgagagcctgaactctctttgcgggccccccaaatcctcatacctacaactctacacacacacacacacacacacacacgcagagaacaccactcctccagagactttgtatgtttaaaaagtccacagatctgaatcgcctcctctctggaccggagcagggcagtttattcagagaaatcaataggaaagagcatttgcaaatatttatataagccctgtgcgtttcagcattaagtaattaaaaactaaaacccgaggagggggaagggagacacacagacagaggaaggctgctggcctagagtaggttttcctgcccacacctcatcttcccaaaccgcagtcttttcaaaactgactccgtgtacactttttacgaaatcctcttcgtacaccatttgctagactatttcaaaatcatctccaaatatggattcacctaccaccaagctttcaagactgactgtgtctgtattctatctctcttctcatacacacacagcaactcatacttttgacactgcgtcaatctctagtatattctcttttattttcctatctctaatatacctgcactagttaaaaaaaaaacaacaaacctaacattgtaagataagaagagggccccccaagtgcccattcaagaagcaaactcccaacccctaggtctcctgaataccccccactcccctcaacccacaggatgtctacactttgggggttcagctcctgaaacccccacatgtaaacagatttggaaaaaaaaacaacttcagcaaaatggagttttagaatgagctactatggagtggacttccctatattgttccggagggcagggcagtaaattctggttgttctccctctaaatcctctctaagaagccaagcaaggcgctggagcacccacgctgcagatattgtagaaatttacagtaaatgtaggtacacgattgcagcacgctgccctattgattatgcagattgtgatcaatcttctcccctcgcccactgcccaagcctctttcggaggacctccaaataagttggtctgcaactagctattctcccaaagtagggaggaaaaaaagtaattttttaaaaaacataataaatcctcaattgtccccactgaaagggctcgagtcttttttaaattccaaagtgaatttatgttctgtaatttgcattacagccaagcgatcaccgtctgtcatattcttcaaaggtacttaacaaactgccttttaaaagtcactagaactggaggccagaaaaaggcaatcagcatgctccgtccatacagtgcttagatcaagtttcaataattgagaccaataaaaattgtcatatttaccctacttgaaagcaacaagggggaaaagttaagactgggtgccttttgaaagcgcttgtaatcaaagaatttgccacagtccaaagaatagcacaacattgaacaaaagtcagattctgagcaacagcttcactcgcaaagtgatatatacatattttaattcaatagttatacaagaaccctccgagtactgagtccatacacaacttaattatatacactgcatgaaatacacttagatctactctccaatagatatgcaaaaagacggacattaaaatgcataatgtaaaattcaggaacacggtttttgcatcgagtggagccgggcgaggggtgagagtggggaacccaacgtaaacaatcccagattcgcgagagcaaaaaaaaaaaaaaagaagaagaagaagaaagaaaagaaaaagaaaaaaggcatcctcggatgtctctgagctcagctggcggaagaaggccggccgggcgaggtctggccctggccagcggcgcagccccgagcccccgggagcccctagtgtccagggcagagtcccctctgggcgctcgcggcgctgccagtggggcagggcggagagcgcacaggtagaggatcgcgcggccgcctcgccccctccgggaccccgtggctccgaacgggctcccgcgtcgccggcaagtcgagccccagcgcggaaggcgctcgcccggccagcggtggcggccgcggcagcagcagtggctgcgaccgcggcgactgctccgggccgggtgcgcgccccgcgcggctgctcagcccggggccccggcgcctctcggggtggggcaaagttgggggccgggagcggcgggggcgggggcactcggcaccgcggacccccccatactccccccaccgccggccgccgcctttgtctccgagctggtaccccggccgccctcccgccctcggcccgcgccccggccggccctgcctggcggcgcctccaaactcgccgcgcgggcctcgccccgggcgcctccaccctcccgggggtcgccggcggccggcggcggcggcgcggggccggggaggagggggcggcccgggctcggcggcggcggcggcggcagcggcgggaggaggaggaagaagaagagaaagagaaagtttggcgtagggggaaggcgagcgggacgcagcgagcgagcagggcgcgggcgcggggagcgcgggcggcggcggccgggcgcgagagccgggagggggcaggacgagccccatgcaaagcagcccgggcgccccgaggagccccgcgtccgggcggtggcggcgggaggaggaggaggagcaggcggcggcggcggcgggaaaaaaaaaagagggaaaagttgccacttacgcggttgcttctccggcggcggcggctgcagcggcgctgctggcgacggcggcggcggcgggagctggcggcgcttttaatcccgaaaagaggcgctcgggccgcg

SEQ ID NO: 1000 - DNA, 265490 bp, Homo sapiens
tttgctcatattttttttttaatgtatcacaatgagcaggaaacatacttgatgaaatattttcaaaggagtatattcaattaccatctacaatcaacttaactatgacaacaaagtttttgtgacaaatttttttttcagtttgaaagttccatgtggttctgtttgttagtctccatgtattttggtacagttcgagatcagcattgttacagtaacaaaaaagctaacaagactacattatagaaaaacaccaagaacatcatttttggtttcacttgctctattttttttgttgttttttgtttttttttctttttgtacattgcaaaggctgttcatatacctcttcacctcagggtcacgttcatttatgctttctttcctacccaaacttgcccccctcccccctgaagaaagtaaacaaacaaaaaactagtcaaagctttgtttcacagtgggcagtatctcagcgccaacaaacaactcaatttatgcttctatttaaaatgttttaatttattatttaaaaaaaatatatgtccatgaacatcaagtgcactggcttgggtcactgcctctctctcctgcaacttcctgccatgcctgataaactcaggtttaaacacatgccgtctgttttactttattttcaattgtgtaaaactttggccacattcatctctttaaatagcttgtaattaaaaaaaaaattcctagatgtattaaatttttccttgtgtagatatgtggtttttggaaggatggaggaaagatggatgaaataactcccattctgtgggtcagactggtgtctagcaccaacccacactatagggagaaaaccaaaaaacgagtgtcaatggaggtgaagaactaatttaaaaagcaagtggaaatatatcctacccagctacctacaatgcagcagacaggaataaattccccaagtgagataaagctaaacaaacagttgagcattgtagtgaattcatgctttgtaaatagtactggtcatagccacgatggctgtcagcccacaaacatctaactcatgtttgacctctaatgttcaccatcactgactgctttgctacttctgggttagtgctgagaattattcttacttttttcaatgaacatatatgtgggcggtttagttgcagaggaaagcattaagggtgcaacccactccaggttgaaacaatcacataacccctctgagaacactaggtgggtggaagtgtgctcagccaatctattcaaccaccttattgtcgccaaacacccacagctcaaggcatggcataacaaaacactgacagtcactctgcctcacagagggaggatggcatagtagctccatgaaaaaaaaaaacaaaaacaaaaacaaaaacccaaaccatcagggagggggcagcaaaattataaagaaaagaacttaaaagttgaggggggagggaaaaggatagaaattgcactattaccaagcaatatcatttttaaaaacaacgttttcagagaagacctagcagaatttgacaggtaaagctagtgttacattgttaactgatatcacatagagaaccaaaaacaaaaacaattttttttctatatggtacagacacagagtaacatacaacagttaaatggcaaaaaatatatatatatatatttcatagagttacaaacaagataaaataatggaaaacaaaaaactgtacaactttaaaatttaaaaatgttcatctcaaacacaggaagaaatacaagatttcttgttaaaaggaaatagcttgttaaaacagtaaatgttttgcgtacttgcttttgacaccttatgctacaactggatactggtatgaatagttagatggtattctttctttagtatttctacttaaaaaaaacaattaaaaaaggaatttgcactgtgcatcagcctagttagaaatatgtacaacatttcaggatctactatttcattaaactaaaaacaaattcataaaaataaaatagtcccggctaaaaaagaaaaaaagaaaaaaaatccattttcagatcttggaatgctccagtcttttgcaaagtcgatgagtggcttcagcactggggaaagaagcccgaaaggtgaccaatggaacctgtattcacagtcttcaaagttcccttttgaaacataaggaagaaaacgaagggaagaaggatttcacactttgggggcaaggggagatggtttctgttgatgtttagctatgaaagtgaaacagcaaagcatctatttatttgtctccaaaatctatgttttagcagcacaaagttttcaaagttcagaccatttatttatttttctttttacatgagaaagggtgtgtgttaacaggaatatggatattaacagaaacaagtgcctcacatacagttccttttttgctttctgtacactgctatctgctgctttgttggctgcgctctggatcactcgctgctcagactgcctaacacaaggacaaaactttgaagtaaaaaatgtgtcttttggtatatggaattgtcattaacatttgcctctctgcttgcagaagaagcacataacaacctgggaatcttttgtttttctctttcttttattaaactaagtcttgtttgtttaaatcagaaacaaattctcaagtaacaagaaccctttcccttttttctgcatcagcagtgaaagggtgtgtctttggattttatttaaagcatgaaatttttttttctgagagaggaaagaaaaaacaaacacaaaaccaaaaaccaaatccctaaccaaaaactttttttagaaaagaaaagtacacagccaattacacaaatggaaacaaatcctttagtatagaaaaaaaaagaatatttgaagctcctaccaaacaaggaggaaaagaaggggtacaaagaaaaaaaagccaaaagaaggataaataaaaaataaatgcacaaagctaacagacacaggtaactagaattatatgcctttaaaaagtttcaactccccaaccaaaaataatctgtgaggatcctaatgacccctagaatcccttgaaattctttctttagttttataaaataattctgcagctccctctaagaaatgaaggcagctaccttaagtgggagattataggacgggaggtgggagaaggaaagagaaagtggaattaagggacaagaaagagaaagtggaattaagggacaaggggagaaaagcttaggcgaatcaacggattgcaatctatcatctgctaggaatgaacaagacaacatcaaatgaggagctgtcagctggaccatacaaaaagctaaatgtacacaaaaggtttttttttttttttccttttaaatctaccatactgcttcagttcatttccaatgcaacaatctactcaacaccaaaaatggtcatatctatcataaatacagaaagtcagtttttaaaacttattttttttaagctacaagtcctcaacactctttgtgtgtgtgggttattatttttttttttttttgaaagtgggagtgcttaacttttccccttgaaattggcttcagcagaaaagctatccttaaaaatccccagaaagctaaagcagttcacattgtttttcttgaatactttctgcccatttttaagttaacaaaacaaaaaatcttttctggaacaaaaaaaaaaaaaaaaactgaaaaaacaataatatataaaacaatgattctgaaaacaaagtgtgagcgattgacctgagaataaaaagacattacatttctttttttcttttagcaagccattggtatctgaatgctaagatagcaagaaatttaaaactgtaacaaggtggactgctttcccatacagtgcatgccgggctcctctgtgctatcagcgtggggcgtttattgaaaaggggcaaatatacaaggggtttaagctccaaagacattagggaggccctgcggacttctgtttcccagaccaatagtaccttcaaaaggacacaatgtaacagggttagggctttttttttttttttaatattaaaagaaaagaaaaagacaagaatgtaaaatcaccggcatagataggtatatgggaaaacaacccacgctttttcttttttttctttttttttttttttttgttttttggttagaagctttggaattgcagttagtctatttttgaaattggtttgttattaatttttgtatttaaattcatttgtttgtattgttcatcttcaaagcttacaatctgaaggtgtccgttcctacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgaggtaaccgttgaagatgaggagagaggaggaaaagaagggggcttcgctgccgaagcccgggagaccacttgcggccaagacttcctggaggcgtggggggaagcggaggagggggcggcggccgacgggggaggggggctgtcgtttgagtgagcggcagactgcgaggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccgccgccgccgccgccaccgccgccgccgccgccactgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggtttgggggattctttggcagggtctttgtctggggaaggagccccgggggggactggggtttggcttgctttgggctgctgctgctgcactttttgctgctgctgctgctgtagttgccgctgctgctgctgctgaattgcctcctgcagactctgctggtattgctggtactgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagcggggctgagatcgtggctgcagttgccgtgggggcctctcctttctccttcttggggacaggcaggggttcccctttccctttgtgtgccttttccttctcctttactttctcactgtctttgtccttgcgttgctgctgctgttgcagtgggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagagaagatgatgaataggaaagtgtggaggaagggcctgggaagaaataagaacaatccattcagggaaaattgcttccatgccttggcccagctgacctgcttcaacaagtctactcaacagtataaccgcctaggaataggaatctggaatctgcgggagaaacgaccatcttcttttcctgcccctgtttgaatgatacacaggagggccagtgggactgtagatggttgagaaacaaccgcaggaaaagcagaaaagccatgtcagaagtggaatagcccaagatactgacaccaattcccaagacatcacaacctacccgaagcaccactgcctatggatagcaaaggtctgaccatatcaccaggccctcatgggctagaatcccatccttgatcatacccctaatctaccaccactccctgcaacgccttcaccaacccgagagcctaataccctccctgacccatagctatctcctggtttgagtcaccaggtccaaggtaatgcaagagggtgttgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaacaagactgcttcaaattgccaatcccagacaaacagctgttaatactggatagccaaggagaaaggttccttcagcatctcatcatgcagtgtcctcagtgcacataagacaccagagaagatatgtgtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctacttttttttcacattactatgatgtgttaagccttcccaagcccctctgccagggtcctgggctgcaggggtaattaaatgcttctctattttccatagtttgttttcctggcttatgtctagctggctttctgtgacatgacttgtcaacacatataagcaacaacttctatgtcttaatgctttcttttcttattctctttgaataagaaatggggaccaggaatgcagtggccttatgtttggtaaaacaccactcaaagtgtaaaatgtggaactaattcaaccagaaactaagattgctgtgggaagcagcacagctgctttaacccctgggaacagggacacattttgaaggcaaggtagcattaggaggggttctcctttggtgaactggaactaatcaattcaggccattgtggggggaatttgcagacttatgtctaagcctaacaggaccctggaggtgaaggtccaatttagcaaagatggctggatccagagaagatgtgaggacagagaaggagaaacaagagaagtatgtaggaagaactgcaaaactccctattaagtgagactataagagcaacaaatatgtatgattctcagtgatcaggagcaaggaaaaggaaatgggcaaaaggaaaaaaaagaggtgactgaggacctctgaaatgtgcatcagtattttaacagaaccacattgcccaatacaagattcctggtcagtgcactcaagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggccaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaacttgtttcttgaaatattccagaaattagtatgccaggaccctcaagtttttccctattataggggataagagtggtttcaaaggagactgttccgaccaggaggtcccatccctgacacaccagtacttgggagactcaacaggaacgaactgaagtcttgttgcttttaaagaactagaaaggtaagcttcccatctgcccagcactcagagggtttgggtggtatccacataacagaatgctgactgggcagctatttagccctgaaacaatcgcctagagcagaacccacctgtgttggatggagtaaagcctggcaaggaggggctgttgaggcccgggagcaacacaggaggaatgccctggagcgctggatatgctgtaggaaggttaagggcctgaagaggggtgttgtcaaacatcccttgctgctgagctgccagtccaaggacctcgttggcctttttaatccggtccaactcttgttgagccatcaactgacgtacggtggctgggtcaaagtattctttctccttgtccagctggcttccaatggtgtctttaactttggagatatgctgttgggaaaagatatggtcacgtacagacagccgagcgctgtacttgatgccacacaaagtgcactctgttttgggtccctcataactcgtttggtttataccaaaatgcttggccatgcttaacttggacttcttttcttttgcccgggcattctggaaccagacctgaacgactctctttggcagtccaatgtcattgcccaggacctcacattctagcatagtgggtgtcctgtagtcattaaagcatgacttgaggaccttcagctgcagattggtcatttgagtgcgaaaacgtttctgcccaggccgatctccgctgtcaccagatttgcctgcagatccactcgcaccaggactcggggagcagggatctgcaaggcttgaggtttcactgtagtccactgtaccttcattgtcatattccttgctataaaagctcggggccgggctgaccagaccagatgacaaccgatcttcatactcagacattgccatcatggccgctttggtcaacccttcgttgggtgcagaagaggatttggtttcagttgctattcccgttgcactgtcgttatctgcgttgccctcgtctccagttgtggtatctgtgattgctgtgttgacagaggaacagtcatcgttgtccagcttagtttggtcaaagtttagattaactgaggacatggaggggctttcaaagtcttcaatcccttccaccttaatggaggaagggcttagaagagttctgggtgacaattccatggttttactcacaggtgagagggggacaccctgaccatcactactgcttgggggtaggtgggaaaagctagttccgtcaaaaatatctcctttcatctggagtcccccatcacagtctaagagcatcgcagacagagttaggttgtagccagctctcttggcttcatgccagtgacgggaccggatatgagcctcaagagcagtcttggctttgaagagcgctctgcaaaaagggcatctcctgtgggcctgcgctgggcctacagcccggaactgtcctttcctttcccgagctcgggtgttctgaaaccagacttgtaccacacgtttcttcaagcccacctcgtgtgcaatgtgatccaacatctttcgagtcggattggaatccagtagatacttctggtagagaatttctagttgttccggtgtgatggttgttctcaaacgcttgtctctctgaggctcttctcctcctgtcccactgtcgttttcgccagggcttgcactggccttttcctccagcttcctcttgagagtgttcattgtggaggttggagttgaaggagaagtggctgagcttgctggaatctgaggtatggccccagagagcagctggctggccaggagtgggttactgggatcaaagagcatgaaaggcatatccagggacctgtccaaaaactgggggtggatgaactggttctgcgcgctcaggaagtggagctgctgatgctcctgccagtgctcaaatgacggaaatgccaacttacactggtcacactggtaggggattagctgaggaggtaggtttgcgagctgttgaggagttgatgtgtggaggggcttgaggggcaggtgggagagctgggaaggactggggctcgactggggtaaggggcactgtggagggggcgcttgtggaggaggctgtggcaacgaaggcagggacaccagctgggggagcttctgctggggagtgttggtcttctgctcgggctgctcttgctgctgcagctctggctttggttgtccttgcttttcttgggtttggtttggctgtgcactgggagcttccgccagctttggtttctcatcgcctgcctctgtttttgaattgaaggtggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcatttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctcctccaggctggtgataggaggattactgaagttgtaaggggagtccttgttacgctgcctctctttgaagagagtgttcctgaaccagtgcttgatcactttctggggcaacccggacttgtctgccatctcttttatttgctcttcactgggggagttgttaatgtcaaaatattgccgcaagactcggagctgatcatctgtgatcctggtgcgaggcctcttgttctgctgctggagcagggttggattgagctgatgctggtagagttgggccaggtccgcaggcagaggctccacaggtcccagctgcgggggtagctgagccggcaaggtctgcagcggcatcgtctgcatcatcagcggcgagaagatgggcagctccatcggcatggagagctgggtgagcggcactgatggctgggccggtgcaattgtaggtgaggtgatgggtggggctgatgcggggatggctggtgtggacgccggctgaggcggcgctgccggaagtgggggtggagggggtggagggggaggtggtggtggctctggggtctggggcctcagtgggtacagtttatcgtagtggtctctgtactgtttggcaaacctctcgagctgtttgaaaggaaagtaattctgatgaacgtgctcttgatgactctttaaaatcaagatgttggaaaacaacttgccgcaggagtcacactcgagcttttccaggttctctccctggtcagtcttcccattctttttctgcaccttctgcttgttctcattatactggatgaccaactcaaagccaaagttctccagcagggccttggtggcgttccctctggcatctgaagcaatgcgtggagggagcatggaaggctcagaaccaccccctggtgccaactctttcttctctttggccttcaaggcatctggcagtgtttccttcggaccggtgttgccctctcccccctcggcgctgtccctctctctctggctttctttttccttttctttgatgaccaatttgttcttcttttcggggtgctggcttggctgaaggagggcagagtgactctgggctatagagagttggttctgctgctgctgcggcaagatctgctgatggctctgctgtgggacctgaacctgagccttcagatcttccagcaggcctgggcctgtcccagtcagtgtcagtgccccactggtcactggcaagctcacctcggggttaagctggaactcagcactggggatgtagaaagggaagaggaggtgctgctgctgctgtagttgcagcagggtctcagttgtcatggggaagtgaggaaggagggtggggttaaacagctgagactggatcagggcagcctgttgctgcagctcctgctgcaggtgagcttgaacttgagcctgggcctgggccagcgtttgtgcttgttgttgttgttgttgttgttgttgttgctgttgctgctgctgttgttgctgctgcctggatgcaatcatatctgccagtttcttccgattggcctctttgggctctgaaggggaagcaatgttggcaccaataggattccccaggggtggcatccctacactctcagtgggcacttggcttagtaagttagagcttggagcaatgccagcactgcttggattggaggtggtaaaggtgttactgccactggtgctcacaggacttggcgtggaggagctcaaggaaatactgctgctgttcccagtcccattgctgctgccacttgcagcctccagcttggctgcccgggccttggtttgatgtaacacagacctcatatggatctccagagtggaactctggctgtaggccacattacaagtgttacacttaaaaggtttgttgtctgggctgctggtgggttctggctgaccggttgctgattcttgaagggctctctttaacttatgcaggtgggagacagaattgtagtgtactagcaggatattcttttgagtgaaagattccttgcagacggtacacttgtaagggcgagaagggtctaggaacttttccatagtaaaattgggaccttttctgaaaggcagagctctctttggctctgagcccgagtcttcttgtactgacccagagtcactgcccgttgggctctgtttatcttccaagtcactctcttcctccttgtcttcctcaacaattatggtatggtcctctgccagagtggggtctcccattgccaggaggtccccattggccagcaggccaccataaagctgttggatgtcagcctcactcagctccaggtggcttgtctcaaggtgcttcttcagagcctggaaagttcggaaactgcgctgacaaagacagcacatggtggcagctctgatcacatggtactgagaatggagctgcaacttttcaatggtcttgaaggccaggctacactgattacagcggtacttgtacacatggcgatctgacaccggcagctgaggcctcttggcatgcacttcattaaaatgcgtctgaagggcagcagaagttttgaaaacctggttgcaccccttcttccagcagatgaagcctgagtcttctctcacagagcctgggtcagcaggggatggtttcaaatctccgctttgctctgtgcttgcggatggcaagatgttctttcccagatcctctgaggtttctgttaaaaaaaaaaaaaaaatcaaacccaaagataaagaaggctttgtttcaaggatggcacccagagcggtctacctagtcaggcctcatgaacacagaatctgatgatgagggaagtgcccaacctgaatgacagaatctctgcggagcgcctcctgctttcttttgttcctccaatagagcacatattataaacagggtgcacatgaacagagatggataaaaggaaatacaaaaagtttcaatgcataatagacccatgtcatatcacagatctaacagtcttttaaatagcatttaattgcttgactcagaatcctcaatttctcaagagctggtttgaaggttactgatcttagactggatttcccttttatgttcatcttttatgtaataagcatttagcacagtagatctgaagtgtagaatatgtgaattaatgctgtcctaagttgtgaggaatttacaagaactgctgaacatcgtaatataagaaatttggggatacatatttttaggcatttaatttcttgttataatgtgacttctgattgccatctctattcaataagcaattaacattcaagtgttcaattatttaaaatacatttttttccctacaatgagatcatcacactcataaataccgagaccctttaacaggtcatttgtccattgtctaatatggaaaactcacaagaaagagagaaggcaggacagtagtgtggccaaactcttcccaacttagaactcttcccaccttagaggtgaacgatgtaggacagcctcacagaggtctaaccattcatctagccaggaaacactatgtggcaccaactactgtctacaacaatgttctttccatcagcatctctgtgcttcatcctaagccaatcccaaaaaactcagaacgaaagacaactaatccagtgtacctaaaaatcaacccacaagtccctactaattaagtcctcagaaatacagtgtttaatggcttagaatggtagggcctactgactgagtctctggttattcactccctaattgtatagtttaagaagatgtgtgtgtctgtgccagaattccactggttctcatactaattttctctcactttaaaccatgtgagtaatatacaaatacatgccaagaagcagagtataaagtagctgatgacagtgcccctcatctcctgatcagttacattcaccttaagagtattgtaaagaattcctgaaaacctttctccatgaacattttggcattccatcttgtttcaatttcttggggtcaagaataatgatactgaccaggctgctttcctgcctcttccaaattggaattcccatctcgatctggaacagctgctgggaggaacatgctgcttggcatcaccatctcaggggtggtcacctgaggagcaagagcaaggagagtcaaatggagaggaaagcgacacaaaataggaaatgtttaaaaattatttaataagcaaaattagccttcaccagtgtaaagctagaggtgtctcacttttcatagctcactgaagattcatgtttattagacaaagctcacatcagtcaaaagtgtttctacggttacattctggacataattagcagtgcacacttgaagaataatcttcttattaatatttttcctttatgcagaattttgactttgatcactgacaatgttttgtcatgggctgtgaaacttcttgtgcaaccaattaggtagataagttgaaaggcccaccttaagctgctgaaaacataataagggccctaattaaatcatacctagtaaagtacactgtaatcttgaagcagggagcattgtagtactgttttcagaacgtattcaggcaagaggaggaggggagtaagagtgaaggaaagggtaagaagaaaagaagagaacaaagggaaggctagggacacgcagacatgctggcagattttccaggaaaacaacatttgtaaccctttacaagctgacatcaagcacaaacaagcctttttttgtgactcacttaagccacgatttcttctggagtctctgcccaaggtatacaacatcagagggaacttctgaccaacgtcccagcgatagagggtggcctgcacagcattctacaacagggcagccccaccttgaccatggccattttttctcaatacagcagttctggaaatcgcctggatccaaacagctgcaacttttgggcagagcctcagatatttctctaggcctccctgccgtacggccagaagcctgtccaaacaagttatcatttgccttatgttaatgtgataagcagccctcgatatccaatggaaagatcaaaggttcttcattcaaaaagaagcaatatccttttgcctgatatggggtgggaagggtaggtggcgatgatatttcaaatgaattagaaaccacctcccatttgatgatagctggagaaatggactgacctagaagttacaggaccagaaactacagtcaccactaacctttctacgtggcacccagccccacttggagacattatttttccatcaaacacaaccgtactgcacagacatcttcactgtctgttgcaaagattggaatacgtagatttctgttcaaaattaaataatattttaaatacattactattaatttttaatggtgtgacgatcccagccttgctcaaaatagctactgagatgtccactagaatcatcagcaataagcttgacaactagaggaaacccagacagccacccccatcaacataggataactcctcatcacacttaggggtattagaataatttcagcaacccagatgccagcgggtgcaaaaagtaagcaacaggtaccatggagaagcattctgagaaatgctgtgtttacgaagagcaggtgtgtggcaggtgaatgtgtgtgacatagcattcttgcccccacagacatctgcacctcacacaaagctcatcggcagctggttaaggctagctgttgatgaatcgttaagaatggagtggagattgccaaactcattccatctattttctttttaatagaaggcatttctgactagtgtggttggggagtccagcgggaatccgagaagtgaaaggtcaccgattaatttgtagtcctcagctgagggggagcacgaggttgggggtaagagggggagaaagggaaaggaaaaaagactcccccccacctcctttctcggttgtagctgcaagatcagtcctttcctgggatctttaggaattatgaaaaatgaatcatgagaaataaaaaaaaagccctacagagtaaaaaagaataaaattatctaacacctcagctgcacatcattatagaaaactgtgggcttttcatacacattacagtaaggcagacatcccctctaacagactcagtacgacggatcagtaattgttttcatacactttaattagaaaaactcagatggctatgaataataatggaaaagagagacttttgcacttgaaaggttgaagtcaatcaagtgtgaatgacggcaaaaaagaaaaaaaaaagacaccaattcatcagccctctgttgtctcgctgcgactttaatcataattcctgattgggattcaagaaggcagtaagcagcggttctttgtctgccttcaccttccatcaattaactctccccgaaatataatcatcaacctcacatgctcctctgcatcttaatctgggcctccaaacctgtaagtcttgccccatatgtgtttaagtaactacttttatccacctgcatttttctcatctatagtgtacccaacctctccctgaaaaaaagggggggttggtatatgaaattttgatgggcaagaaattcccaggaggcaaagaggaagattcctaaagagaatcctaaggatctggaaattcaggtggcgtctgtctgtgcatgtgtctcaacagaggttgagaatggaagctgccttgctacacaggctactggagggccccatgtcagttctcagacactaacgttccctttgcccattcttccctctcctaccagcttccaaagctttttactcaaagctttcatgctttatcttgaagagccataaacaatcctgccaacagagcccattgaggagtccttctgctcactgaggtgatatatatatccaaaggcagacttccttcaacacttgccttggcaccccctttgttttacaatcatatctggctactaaactgcatggaattcagactgtcccagccatagtctctaatggatagctgaaaatgggaaagtaataacccagctgtcggccgggtgcggtggctcaagcctgtaatcccagcactttgggaggctgaggcgggtggatcatttgaggtcaggagttcaagaccagcctggccaacatggtgaaaccccatctctactataaatacaaaaattagccaggcgtggtggctcatgcctgtagtcccagttactcgggaggctgagacaggagaattgcttgaacccgggaggcagaggttgcagtgagctgagattgcgccattgcactccagcctgggcgacagagtgagactctgtctccaatcaatcaatcaatcaatccatcccagctgtgctgagcacaggtaaagaccttcccttttgccaggaacactgaaacatgtaggtttatgagaagacaaaacctggttgtagcataaccagggtcatgccaagtgtgccaaatttcagaggccctcaaataactggtcctaccaccaattttcctgcagaacaatatacatgctttctctctgttccttcttcccctctctggccgcaatcctacaatgtccatacttccagccatggactcaagagccaaacgaaaaaagttctaaggtttggccaggtgacagtacaaatcagcccaaacacctacactttctacattgaatgtaccatccacattgattattccgataatccatacatcaataaacatttaatacattaaattatatcccccactctattcactaatgaacctgagaagtaatgagaagacaaaagtttttctggttaagaaaattcaactgattacagccattacagcattttgggtctctcaaggttggcctctgccatgcaaaaggcagttccatggtgatcttctagacaccacgttttcctcccaaaccttctgagccagttcaactaccttcctcccagagtacatgtacatttcatggaaacttgggaagaaaccatcagctgactggggtgcagaaaatttggaagccaacagtggctctgatatattcctaacaaacaggttttcatgcataacaaaagaaatgtagagttctactccagtgctcaaaacctcccagtttaagtaattttcatatataatagaaacagaagcgttccacattgatgctaaaaatgttcaagcttaagcacttccaaaataacacagttgaaaaggagtagccttgagaaactctcagttcattcaattgaccaccatttactaaataaacactgtacaggatccatgtgctgcatgcttctgagatgcagagagccagacaaaagttcctgtctccaaaaggcttatgatgcagaataaataaccctttagaggtcacaaaagccttagaaatctaatacaagttgcagactcctaggaaaatactttcacagaaagaatattccagataattttaggaaattacaagctccccagaaggaaatccatgtactcaagtgaactgcccttgatctactaggagaggtaacatataggttcataaatacatagttccaagctcttcctagtttggttcattattattttggattatgttctaatgcttttcaagattctatgaggtgagtggaccctaaagcctcaagggcacaccttatacagcccgtgtctgagatacgggactagtctcccactctgacatttgggaggggctgctgaaatatataatttcttggtagaatctggagttataaggaacaccatcctgccacttacgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagagggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgagccactacgcctggccagcagagatattttcttagcaaaagtggtgaacctagtttctctgagacccttattcctaccgccttggcattgctcactttaggacttctttctgaaaagcccactattccaggtgaaagtatagatttgccgatacctaggctcccaaggatgcctcaaatcctttacttttaattgaaaatcaatagaatgaagaaattcagacaaaaagaggagagacctcaggcacagacctccttggcacagaccaagccagtctctacatccttgtggatgagactggttctgcccaaaacattaagcatgaagttaaaagccagctgcttttagggctgagcagtctagctagttggtatatctaaagccagctgttccagcgagaggccagttgctcacttcctttcctgtacctagacagccactggggcccactggctggtttctgcacacttacagccaacaaaccagggcgcctcttgccagtagagtttcagagttgggttccccaccccactttacagtcttctacatatgccagggagaatactgggccatggcgtctttttaaaaggctcagcttcttctctccttgtcccatttccttttctttctttctttttttttttgagatagtctcactttgtcacctgggctggagtgcagtggcacaaccatggctcgctacaggctcaaactgctgggcttaagtgattcttctgcctcagcctcctgagtagctaggactacaggtacacaccaccactctcagcaattttttgtgtgttttgttttgttggtagagacacagtcttgccatgttgccctggctggtctcgaactcctggactcaagccatcttcccactttggcctccttgtttcctttctaaaactgcttctgtatggtagttcattcaatttttaaatacatcaagctcaaaagaaaatactgtagggccgtgttaacattcatgtaggctggaaacaaatgtagctcagaaccagatttttgaaactgaggatgagaaagattgaaaaggtagatgggagaacaggaaacacatgaagagttatacacgtgtgcgcagagaggtgagaactgagaaggagaatgaattggagagaaaaccttcattagactcagagagggaagcagtggcagtataccaaggtcacttctaatttagaccatctaattggcaaacaggctccaaatggctatcatctcacagggcttggaattaatgaaggctgattattttcattaccttcctcttaagatacaggcaaagtgagagagctggtacccaggtgggtgcaaccgcccccaggccagtggctgccctagagccccagataaccagcctgtcctagagattcacagacacacatgaagcatagagagtcacagacgctgacggaaaaaaatcacaaggttacaaactattggtctcaaaagagataccgagaaaagtgcaggcaacacagggccaggagcatggaagggaaactgtgcaggtacaaaaaatacagaataattaagaactaccaaagggagccaagacaaagggctacagaaggtgttcctaagctgcccaggagccaatcccatctccattatgaggtcatattttgttaaatgatgaaagaacaaagagaatttccccatatcagtgcttcaggatcccagtggtgtgtcctgtcacttagaaagatagtgatcaattagaataatttaagagtattgaaatgcatggtaggtggtctttcctattctcattcaggggacagaaacatgggccccatgccttccacccttctttcctgaaagaatgggaaaataagggcaccgagcagcagctcctacatctctttcaccaatttgaaatctcaagcttctttgtaaataggtgagagttcttatgtgtaactgacattgggggagggctgcccagccagttgtggaggggcccttgtctcatctcccttaagctttatagatttccttctttgatatgacgtgtgcagaggtactctttgcagctctgtttccaataggccaagaagaatgaagtgctgtgggtgtggtctccatagtggagggccagcactgcaattgttcctagtggagaatatttctcaagccccctcatcagtaagaagggggcccatggaagacatagatatgagatgcagagcataagcaagcagctgttaccatagcaacagacatattagacactgcaggttcctgaaagctgtctgataaggtattattaaatgaagcctcctcaaaacgcactccatttacaactgaacagaaagacgttgtgtagaaagtaatctgtttccatttatcagggtggaatttacttttagtgggactgaaccgaactcaagctaaatcctgagactttggacacagacagcaaaaaatatttaccagaatttacagctgtaaataccccggacacaccccatgtctgccaggaatcatctatttgggggattttgcaagcttttcctattctgcagccaatggcaactaactcagtcaacccatttggaaagaaagaagattcactcttgctgccattcatcctagccactcagggacaaagcagacataacttccttctcctggagcatgaatgaccgtagaactggccattccttaatgatatggtttagaaaatggagccctgattagaggggcatttttcatcatgctgttttcactttcctgctctagttggccatgaacaaacatatatcgttagaaagcctaaccaatactttcccggggccaatcttctaataaaatgacagtaaaataccctcccgtggcatgattttaaccataggttcattataatcacttagttgtgaaacaattgcaaattccatttttacaccaaatttttcagaggaaagacactggcatctgctttgattcatcagagcagagatcaagatcatcagtattccagtcctcaaatacgatctcaggttcaccttgtggtaggcccacaaattccctctaaccctggttgctcattttttttttcctgctgaactaaaggcctgagatagaaatgcatagtttggctcaatgcaaactatccccatgactggacaaaccagttcaatactgacagccatgccataactccatgcaaagagaaaactcatccttgcatatacatctttcagtaaaaagtaaaatacttatatgattacatttctcataactttcaactttattcctgaatccattgactttcccttgttgctaacaagttgacttcctattacaagtgcatttcccacaatctgcacacttctcagaaatgtctagaaaacatctccatggtctgctgtggaaagatgaggaacatagaggtttctatacaaggtaccaagcccagcagtgctttagggagcagtgtctcctacataattacattgtcaggggttctagaacagtttgtattgaccagtcccatggacatatccttatgctccctggcattgtacacacaattttatatttgcaaaatacttgacggagggtcagtaacagtggttatcaaacattggtatgcaaagaataatacagtatggctgttgtatagctttcatgagagtctccataaaggttaagaatcactgcttccaaaggtgctagttaatgggtaacttccagaaatctcttagggattggcacccaagcaaacacagaagtaatatcctgcccttgaagactctgttggtaaatgaagattcacaatgaccaccacacttgtcacttgaaatttaccttgctattgctattatgaaaatatgacaaacaatgaatatttgaaatataagttatactctagtccctagggatatataaatgaaatttttactaatgtaaaccagtcatgtagattactataggcccacagtccctagactagatttatattaaaatagcaaaaataatcacctgagtaaaagaaaaatgtaggtcagtattgacaatgcttccctccccacatctctttctgttctttcaggctcccatggttctaggccatcagatgggaagtacaatgaggcctgttacttccaaggatgatgagaaagctgaggaaaccagtaacacagaaacccactggtccacagaaggaggttttcacttacagagaatctttacacactgttcaccagctgatttgaaaatacccacagaaagttaatttaacttcaaagatctctgaaaggcaactcatggctaggtcacctttgagcttcccattggctgctaaagttctcttgatgcatcatcaattatatattcttcatgactaaacatcacttacaacgttattcattaacgtttgcagaaccaaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtgagaataattctctttggtggtttttcctctaatgatcaggaaagggcttttttttttttttttgagacggaatcttgctctgtcacccaggctggagtgcagtggcgcatctctgctcactgcaagctctgcctcccgggttcacgccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagcgcaatgtcagctcactgcaacctctgcctcccgggttcaagtgattctcctgcctcagcctccttagtagctgggattacaggaacccaccaccatgcctggctaatttttgtatttttagtagagacagggtttcgccatgttggccaggctggtcttgaactcctgacctcaggtgttccacctgccttggcctcccaaagtgttgggattacaagtgtgagcccccacgcctggccaggaaatgactttcatagcagcaccaacatagtcaaaagtaggacatcaccatcactggcactattttgaaaagtttttatattacaattagatttacatctttacactaattaggccatgtttatagtggtcacttaggggcatgctttcaaaatctgcagttgtagcaatatcatgttcaaatgcaaaacccacattcacgaatcagcaatatccagctcaccattttcttgctttaaaaatcaaagtatccactgagaaactccctaccctagagttggaaattgcgggttcaaatctcaactctgctccttacaaatggcatcaagtcagttaacatctttgagcctcagtttccttatctgctgatgggaatgtgtcaaaaaaatttttttttctttctttttttaaagagatagagtctccctctgttagccaggctgcagcgcagtggcctaatcatagctcactgcaacctcaaactcctgggctcaagtgatcctcccaattcagcctcccaagtagctaggacaacaggtgcatgcaccactgtgccttgctaattttaaagtatgttttgtagagatggggtctcattatgttacctaggctggtctcaaactcctggcctcaagcaatccccccaccacggcctcccaaagaactgggattagaggtgtgagctagtgtgcctggctcccttttacaacaaaaacagagtttgttatgaggatgaaatgagacataatgaaggtaagagcaatctagttcatgacctgctcagtaaaggtttgaagaatttgaataatgatttcttcatataaatggttagctaatccatgcctctgtcccctgagggcagagaggatgataagggaggttgagaaacacatgttcagcactttgggctatggtcatgccaagtctaaggcagggatagtacaacaaaggtcacagaacaaggactgttttctgacgtttccaactctacactgactttctcgtccaataatacagtatcttgcccatgttactgcatcacctttgaccctggagaaagaccacagggtgctgctcctggctgccttaccgtcataatgagcttctccacgcagtcaggtgccacgctgtggaggtgggtgaggtgcagctggaggtggatcttgttgttgagcatgtcctggcacagggggcagcgaagcatgggttgcaccgagtgctgcgtcatggcatgcacccggagccggttgacatcggcattactgtacttgcagtagggacactggtacatctgtggggaacacacccactgctttgagcaactgtgtgtgccccaagcccgcccacccaaaagtttgttccctaccaatgtctaaaacacctcacctccccaccagcagagtcccttccagcctcacctgctccggtttgatctcctcagctgtttttggtcgcttcgaagagaggggagactctgagctacctgggaaggagatgcgtttggaggttgcaggagaatctgtcagctccttctctgcttggctggacgatgctaaaagagaaagtagaagatgcaatacagcagccagaccaggccagctcccagagggtttgtgttgggtgaaaatcaacattcatttatagcacaggattttcttaaaacaccaaaattcaagaaggatgaacatccggactgatttatcaagcatgttggaaaagaagcaagtgtttctttctcccccatgaatttctgtcactactttaacaactgaacattaggaaaagaaggcaaagaaatggaataaaaggctctggagttggattaagctaaattcagtctgttctaacctcccccaatctagatacaatctgctggcttgtggggggcagtagggctgagggtgggtgggaaagtctcaccaattgctttgccagcctcagtaccagacatgctctgcttcagaaatgtaagaagagatgtgctctcaactttattgtccctcctcttggaatcacaacatggcacagcattggcaacatgaaaaatgtgatttgagaaaggttcacatgagtatcagcacaccaaatatgtgggggaaaaaaatcaagtttgggttcagcagtttgcttttggggaagaaataattgaggagtggaactaggcagggcctgaatccaagatataatctagccagtgctccagacccaagagtttattcagagtgggtgggaatagggaaagtttcctatctgcttgcccaaaccatgcctccatgcccctcttgcttacaccaccaaaaaaaccaaacgctatttaaagaggagtggcccatgaggattgagcagcagacagcacgtacggaagtgctggtgggaggagttctctgaaggatggaaaggaaacatttctttatcttctctatttttaaccccaatcagtaggcattaggttaggctcagggtttatagttaggaaaaacctgctatctgctcctccttccagtagaggcaaacactttgataagaaaacagccaggctaagggtttatccaggataagcaaggctcctccagcttaaacacagtatggttggatctggttgttccataacctggtcaatatctgagtgttggctctttcatttgttttgaatatgggactccatttttcagaattttgtttaaagcaataagaaaaaaaaagtaataaaagtggtagtgagaaaatatatatacccacttccctcatgaaaaaataatgtgactcagcattcaggtcactgaattagaaagcccaatttttattccctgttaaactgctttctgttttaccctgtctagttatctggcatatatttccatttatgcttgggtttgaaatttgttctgatgtggacaccaagatgctgtcattactttaataaacaattttagacaatcaattttattcattaaaatcataaggccacaatataattttgaaaagaaatttgccaaatgcaggaaatatattccaggaagttgatgctcttcccagagtgcacatcttgtgacctttaaccccagtatcttggtaacctggtctacataagtttgtaggacatctattatttaaaaagtacaaggacgagcatattacacacagatcctcctcctcccaacacacacattcataacagtattttaatctgtctcgaatcgacttcaaacccattttgctcttaatgggagttattcattttcacttgaaaggtaatacatgacggctggatgtttaatgtgatggaatggctgccgattaactaggtgctgcaacattctagaccagttcccccatggcctacttcccatctcctggccccgctcagacctgatcctatggaacgtcgcgttgcaggtttgagaccttgcagtgtgatgggccgctcctgaacacatctacatttggagtccttaattaatgtttcaggaacttaagttcccttgcccccagaaacttccttattctccatcattttgatttttgcttagtggttatcttctatatattaactcttcaaatgcattctcaagatggggtgggtgagggcatcaaataatacttccagtgtttatttgtcacagccatttctttaccttctctattgtgaactccaatcagtaggcattaggttaggctcagggtatatatagttaggaaaaagctgctatctgctcctctttccagtagaggcaaactaagacatagattctattccatacacccatccccatccttttgttactctgcctgactaaaaacaacacctgttttacaggactgtgactgccttgtaaatgccctcaatctgcctgccccctactatggaatgagtcaattgtgcacttgctcaatagtgtggatgaatgggcaccgaggctgagaccacccgactcatctcactctcccagagctgaaaagcaaacacagtaacccagtgcagcattagtttcctcataggaccaaagagtccatcctcttccttgaatgctgaacacatgatgaattgtggtgaggttgcagaggtgagaattctggtttcagaagccactattctttccccctgcatggagaggggaacttcttttttttttttttttccaaactcaaactgctctggaattctaaagcttcttttgtgagcttgagctaaggacccattataaagtgttttaaaaaataaaatcaccaattgctcactcatttttctttcttcccagtgatacaacagccctgctttaacatgaaatgctgcatccactggtgcacaaacttcaggttcatctagtttctatctaggacaatctgcacctttattagatcaaatctgtctagaagtggatattagccacctgcagctcactggccccttctctaaagataaagcaatgccatccttataacagattctataaacacccagttacaatctcattgtgtttgcctgagtgatgtggggatggctcctaagagttaactatggctgacacatgcccctcccttgcttgacctcagacattaaaatgtcagtccctatcaagacatcgtaccaaagtcgttacaccatttctgtagatgggcaaacagttgtgcaagttctggcaaggtgcagtggctcacgcctgtaatcctagcactttggaaggctgaggtgggcagatcgcttgagcccaggagttcaagaccagcctaggcaacatggtgaaaccgcatctctacaaaaattacaaaaattagccaggcgtggtggcaagtgcttatagtcctagctactcaggaggctgaggtgggagtatcacctgagcctgggaggttgaggctgcggtgagccatgattgtgccactgcaccccagcctgggtgacagagtgagactgtctcaaaaaaaaaaaaaaaaagagttgtgcaagttctccatcaacatgctatgctggatgagggtttatcacagaccacagtcagaggttctctcaagtttcttctctctgaacagcttcaaaagggccagagtctcagaatcaatttctacttcagttctgtcactagcatacatcgtgggcataagtaaatgaagttgtatgaataccaagagagaaagtactgtggtttctcactttgaaggcttttctaaacttaaactctagaagacatgtcacaatatacaaaacacttttaaaaatcaattactggtcactttaagcctgcgatgatgtcacataagtgaaatggaaatacatgcactccagagacaagacatagtttagacaattggtgtctggaacctttggtttacatcggcaacaaaaaaacaaacaacttgaagcgttagtaactctagtggtttgtacaataatcacaaaatgatttggaaacaatctagatatcttacaatagggcatggtataagtaaacaatggcatggccattctactgagtattagaagacattaaaactgattgctatgaagcaatatggaaaaatcattgagaatgcaaatcagaaaagaagataaaatgtgtattatcccatgttacagctatgtaaaaagtaggtattagaaaaaaagactagaagaaaatgatcattgcctttaggtgatgacatcatggaacactttaagtttttcacatagtcattttatttttaatattacagttatcatttaagttcaactgtccatgaaaaagttggtattggctctatactgtgcaaaacatcagatggtattttttactttgctggtaaaagcaagttctctcattttggcagttataaaatatgaaaatatgtgttaaatctcagtgaatcttccataggcaacatgttgggctcctgggatttcaaaggggataaaaatgtggtaaggaatcatgcgactgaatgcgctatagatgacaaactctataaagctaggtaaatgggatattgtgacaacgaaatgctgggtcaaactcctactcaaacttaacaggacgtgagctatggattccatgccacacagactttccagggagtgagaaagcacttgctctgcttgttagtgttatggtggccctacccaacgcgtgctgatgaggcacaggaaagactagcatgtccctgttatggagttcagaaaattcaaaagtcagctctctgggccaacagccaccacttctcctcattctgtgatgagttggccaactaaaactcacaaagacaaatactgagagaaacaaacctgttcatgattgtctattttatcctcttaggctcctctgcattctaggcaaaagaatttcatttcaaagggaagcacagttgtcaatacatggctcccttagggggaaaatcatttatgcatggagacaccaacttccagatatcctttgattttatcatatttgttttagaagtattaaacctctaaaaataattactttaaaagttacccctctactcatgttagttagagggaatagggaagagagctgataagcattcatgcaaagttttgtttggaatttgcaagaaatggttttattacgttgtaagcatatagaataatgaaaatatggctagcaaaactttgtgtaggaagtgacttactttaaggaacagtatcacttagaaaacttgtcaagtggacaaagatggtagaagcacagcctttcaacattcacagtcccttataacttcatctgataaaaccattcttgctagaacaaattctcatgtgatcccaatctttgctaacaaattcgacatccgaatcactgaaattctggccacagaaaacttaagagttgtgcttgcaatcccagtggacttaatgccaacacaggcttcatttctcatctagtaactctgtacaactctgaagccaagtaaggcgtggagttgctgcttcatcaaagataagcctgaagaaaaactggaaatgaagtaaaacatggaaccttaaggtccctcattttcaagatatccacttgccctccaagaaaaccaacatactggtagaattagtttctgtgtttcctaagcaaaattcatcttctcatcactaaacacaccagtgcgctgttggcatggctgcatcctacgatgcagaccattctccctctggccagaggcctccctcccttggggagatcctgggcaggcattaagctgtccacgttactgggaagtttcttttgcatctcttcatggtggagtgactcctggaggtggtaatcaccgaagtgctgatcctcttcctttttggcgtcctgaggtgagcccactgagggtctgggatgctgcctgacacttgaaccttgtggggaatccaaaggcagccaccacccccacctctcaaccatcagactcttagctaaaaagtaccactgacagcccctccatctaaatttccatctcccaaaccagcaacataatggaggagccaattaaatgattattaattcatgctactttccgtaagccagaggttctcatcgccttacattccgtaaaccagcttgccacctgccccagaaatttacagcaatcttttctctatctccgttgactagcgaaaaaagaaattcacatagctccatacttaatgtctgagttgggataactattccaacacacaagacacagatgtatcaccagatctgaaaatggtccttcagctcataattataattaaatggaaggtgaaatgtgtgtttcccatagctcctctctctcagcttctcatacctcatgctcccactagacagcagaaatgcaatgtttccagagggtcatctgtgcttttggattttgtgatctgactttcattgaaagtagagttactcttggcatttgcttgcaattccttccccagaggacaggctgggctttcttacttgaatctcctgtggagctactgcacttgataagtggccaaagatctagctaaattttcttcctccccccaatagagagaacaacagttcctttaaagaatctgctttcctgccaacttggtctttaaacatgcatggtctcattctgcctccaaccaagcacttagagatgtttccaagaggaataggggaagaggggaaggggatttgtgtgaagcagatgcacgcacatgttcactcagcagggggcggtcttcaggccacagctaaaaagaaactgaggcttctctcttccctaatcaaagaagcagaatctgtctcaacatccagcctggtgaagttaagaaccttctattcaaaacacagtcttattctaaggaaatgcaagctatctcgctcccgtatatccctagaaaacacctacccctaaaagtagaatatgcttacaaaggtatggcaagacacagaggttctatcaacttcacaggccttttgtttctaaaaagggtttcaaagaaaatttgatttatactacacataggtataagagttactcagggaaaggctatttttcttctccaacttaaatatgaacaaaataggtcagcactttaaaaatccagcagctcttagttgttattattacgattttactttttgtttggaaataattatagcttcacaggaagtctcaagaacagcatagagaggacccatgtacacttcacccaggtgttacttattaagcagtttagataaagatttccaggtcttccatcactcttcatcgtgaccctgcctctccggctccctccctccctccctctcccccacccccaatcttgcttacatctaccaagacttagggccctatgcctgtcatacaccttccctgtcctttaggaaagctccatgcctccctaacccagcaagggctcaggacttactgtctagttaagaagtcgatctcaaaacctcacgcttgtcactgagatcgcagccttgaggttcagcaaatgccagaatgtgtcagactcccgggcagggctcattaaaacacagatcacagcccctgccctaaggttctgattcagtaggtctgagtcagataatgtacatttccagtaagttcccaagtaatgctgatggtccagggacgacactttgagaacagtggtcagagccaaggctttgtgtaataggtaggaaccacgctgctttgtggtctaactagaaataaatgagagggcccagcaagcatgggccaatctgtcagtccactttaaatggctctgatgacatgatactctcatctaaactcagggatgacagccaggtttggtctcatagcctagatgttttaaaacaccctcaggccacctgcttactctaaaacaaatgcagacaccttcaaaaccagaaattcagaaggaataagctccatgtgttctgttagcgtaatccagaataaggacagacttccttgtttacagaaatctctttctttccacatgtcctgtcctggagagcctctgtgaaaagagggcaaatacctgtgggctccttccaccttgcagaaagaggaagcgtctttttagtgctggcttccctcggtcaggcacctgcaggcctcagcagctgaaggccctctttgcttcagccctggaagcatgcacagatctatgctagcccccatttgcacaagtcagcaatctgggaatgggggttcaggcaccattctgtggggcctctgctttctctgcaggaagcagcctctctggcaggctctggaagcctcaaggtgggatggtgggcacacgctgaccggtgggtgctgctgcttgctctgcgtattttgggagaaaaatagtgctaagccctacatcagagacatcaatctgttgcactaattccttgctgaagtatgcataaggctgcttaaccacactgatttgagttcccaaaaggccattccacatttcaatttcaagacaccttgctccctctgtgtcaggtttgcaaatgaaccaccagtcaaaacagagccaccacctggtttagaccaacatcagctgttggtctgtttaataaattataggcactggactgccaccgtgagcccggctcatgccaggatttggaggcctgctaaatattcctgattttgattttgacctgattcctgactttgaggtactgagtcaacctgcctgtctttggcctcttgttggttcccccaaaatatgctgtcttcccctggcatagcttactgcagctatggccatggtatcttgtgaggatgggtggccacagtccagggacacactagggggtctgcacttattacgcttccctgtggctttattacaggactgtgaagacaaccagagtgggaaggaacctcagaaacctttggaccaacagaggaaaaagcccagaggtgcaggacatagatcaaaaccagtcgcatgcgagtcattctaggatccggccaaagttaattaacagagggccattcagtctccaccgagtcaaacaataattaggttagttagggtctttgagccccaacacagtctagactctgagacactgcaatataacaatattcttctggtttcttctccattccaaatctatcttcctaaaatactaaattttaagagtgaaagtgaacttgtgaacataaacaggtaaaatgtgggtgtgtgtccagaatggtgacagacagggagaactgctgaatataacttatcagaaccttacaaactggccttccctcatgatccacctagggtttctttttactagtcaggttccacaggaaaatgtgagaacttatacttagggaagaaagacattactcaggtccctgcaaggctggaaaatgggaatgattctccactttcccctccagatttaagcactacaaagactgtcaacatctcttggcattttgtacagtacagagagatagacaccctacattgtgtaatgtttatatttaatatcagtgctgctttccgtctccattgagttcccacattcagctcactcacagcgctccaaaggcctaggataagtgacctgtgtgaagacatggggaggcggttctggagcaccttcaggtactcctcaggaactgatgttttttcacttgttgtttgcctaaggccaagttctctttacccgaaggcatcattcagccccccttgctaggtaataaagcacaatattttgtagcgctggtcacagttggttcacatcctggctgtgtgacctcgagcatcctatctgactacactgagctttctgtttcctcatctgtcaatgggataacactgtctacacatggtttctgtgccgctagccagagatcaggcatatgatgcctaccacagagtctggcacatagtgaaagcgcaaacatttgttgctatggtttcttttttagaaggattgggaaataatactgctggggctataaaaccatagaacgaggggagaaacttgtttatttttttgtttttatgggctttccaatgaagagcggaaagcctgctagacaaattctaaaagctgtaacactgaaacttggtttttaagacaagcaaagacaccttaaatttgtcttttctctataccaggatgaaacaatcctattaacccatggatttaatgtctacaaagcagaaagtagaataacttggacttaaaggtacttatgtcatgctattttaccaattgattgttaacgaaacatctaaacagtattaagcacttgctaggtgctggggattacaaaaatcaatggttgccacatagctcctaaccataaacagctgacaaactctatctgacaacaagagaagcatagaatttaagttctcctcctccaaccttcctaaaagtagagaaagtgataatgttacatgttctttggctttataatgtagaaaatatatctgactcagaaggcaaattgggatttgactgcaactctgacacccgagttcccaatctgtgaggcttagttctcgaggctgcaaaacgaaggtagcattggacccaagaagaatatgagaacctaatgaacgtgctctaatatcccccatggaaaggcacaatggtattttttttaaataatcatgattataataacagaggtactttacaattggcacaaaagttaaagctggaacaaagcaggcaagattaacatggccactctgtaagaataatatgcaaatctataaggtattttctatagtgatgaacaatgatttgctccttaatctacattttcactgccctttatctataccttgatgatagttctcattatactgtgtcataattgtgattacatatgacaacacttctagaaagtgagtttttttttttttttttttttgcatgtcctgtacctgccttagatatgtgtgcaagaaaatatttgttcaactgatgtggtccctatctctcttatgacttacaacataaattctcaaagccaagacctttgaattaactggaatttgggcaagtccagatatacaccacagcctgtatctattttggcttcccaacataaaaatagttcatgatttgttttcaattgtgagacagaattccgcctgcagtgactttaagcagccaagtatactgaaagtggcctggaaaaaaaagagtggggagtgagagaagggggcacaagctgactctggaaaaggtgacacagtcacacaattccaatctacgtgtgaaaacataaaaccaaaaatggtttccattggcaggaccatgaaccacaaaggggccacgcaaaatgggctcccagtattccctcacatgcatcctactgcaaagacaaatttacttttgggtgaggtggagaaatgaaaccaagtaccagaaagatacagagttaggccaaaatgatttttgtagaggtatggtggtggtgttgaatggcctggtttctagtcaacaacagggttgggatatgagtggccactcaaaggcacccatgtgagtctccaaggactcctctgttgatgtcctcatcacactgcctctgacaacacagtgtgtctgtcccaagaacacagaactaggtaagggcatatggtgctcagacattccatcaagaaaagtagccttggtgctgcctgacctccattgagaaagccttgagccttttatccagggtatattaactagccacagacaagagaaatctgggaaagttattagcattccaactttagtaattaatatgctccaagattctataatgctctacaactgtccctaccccagtcataatttatgaagctccagaattgttaataacccatttggtccaacctgccactttacagatttggaaactgaggtccagagacctcaggtcacgcaggtgaacttagtggcggaattaggccttgaacccagggcttctgactcctacgagtcctgtatttttcctaacacgtttcctctcagcacataccttcttttgtccttagagactcaatttggaaaaacgaaaaaaaaagtattttttcagcccctttccattctttgtcacagattatatttcaggcactaagttccccatacaaaggcatctctatttatacaaagctgtaaacaacagggaaaacagggggagggctggtaatagatttgcaccaggatgtgcctgacctgctttttttcaacctcagtaattagaaaggcagcaggtctgtaggaattattcatatgcagcaggagccatacgctatacatttatgttaaacatgtcaaatccgattggaatcatgcctgccagcaccatattccataaacgtacttttccctaacagtcacccagaccttgccagcccattaatacttcctttaatagcaatcttctatagattcaaatcagggacgctccactgcactaattgctgtgttaggtgagcatcatagatttaaaaaaattaataaagtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattaccttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaaccacaaagttggacagtggcaatggctgtgcattagggaagagaacaaagaaccttcctgtacccttcactggcccacaggagtacatcacactttccttgacaagatgtgcccgcaagggcctgttcatgtgctaccactcaccctcttggaactctcaggcggttgggactagtggatatcccctgtccatgtttcacagaggaggtacctgagccgaaagaggccaagtgcctcaatcaaggtcatctgctggctggtgggcttcctgactccaaatctagagtctttccacatcaccatcccgctttcagactgagcacaacgccagctccttacaagacatatatccatggttgataatccagttcattttgaacatcctggtggttatcgtgttactatgatcactgtacaatgtcaggagactgctactccttatacttagacatagatgaaaactagatctaatgatcaaactgaaaatgatccttctctgagagatggtatattggtaagagcttgggctctgtcctaagttagaataagtgcaaaagccagtgtgtaaatctgaacctgtctgtataccttttggcgatgtgctagagattcttaccttcctttttttcacatcatggcacacacagaaaatgatggcaaattgggataaacagatgaagcaggacctgtgtacctgtgagcaattcatggcatgcctgctgggaaggacaggtgtgaagctctagaatggtgcctggcacagggttagagctttatgcagccgttataattaccagaaagttgctgtacctatgatgcattctttcagggttagttttgttcctttggggtatctatagctgcacatgtggctacttaaatctaaattcattaaaattaaatacaatttaaagttcaattcctcagtggtaccagccacactttgcaggctcaatagccatatgtggtaaatgactatggtattgttcagttcagatgcagaacatttctatccataccaaaagttccattcgacagcactgatctatagtaatatcggtcttacgactacgggcgttcctgaaatccccagaagaatgttagattccctgaaggcaggccctataatctcactgaatttgtgatcagtggaactctgcccagtgcctcgcatggggtagggactcagccattgatcgtggaattgacccaacctcagttcagatcactatcttgcttgctgtgctgccacccagggtaaaagacctgacatctgaataaaagaatcccaaagaggaacccccaaaaaggaaaccaggaggcccactccaaatgtagaaataaatagctgaaagtgttcagtacagagtacccattcctgcacaaaccccaaaactacaaaatcagtagctgagaaaatgccaattatccaggcccatctgaaatattattaatctgcatcatgaacagccactaatcaacataacagattgtgaaatcactatttatttacttgccaggaggaagcattccccgtcacatgtaatcagataggaacagctcaatttagggagagaatagaacaaacgtagttttaaaaatatatataaaataataaggatccagaagaaagctcagaggaggttgctggcacctgtatcgattccaagatcaaatcggcccaagtaccttaataaagcctgtcattacacactcagatactatagacaaaattatgcttcggatcaaaagaggatcatttgcaggagtcgggaaagaattttcccttctctctttactattgtgcagctggcaaggtgcatctctgagttattcattcaatcactcattcattcattttctctctgtcttttggaagtaaagattaagtaggcctggtgcttgaatgaatgcatgagaaagtggaaccttattaaggacattcattttttatggtgctcattttacgtcttttagtagtctcctgattgcctagcatgtccactagtgctgtgaagacacactcccaatgaatcagaaacactctgagtaagatttaattgaactgctctcaacaaaggctgccctaaactggttggaaggattagagaggcacatatagagtggctagcataaggcagcacatagagtagggactttgcaagtggtggctcctgtttattatttccgtagtgcccttagcacacaaaatgcacgaaacatacgcaccaaacatcattcgcacgatcccattaaatgcttgtatgttgcttctccctcagctcaaaattcccaggagccacatgctgccttgcaacagaggacccaaagagaaactgctaccagttttcctcatcttatatatcactaaaccattaaacaaacaaacaacttacatagagcttacaacatgccaagcactgttcggagcttcccatagtcaaataatcctcgtagcaatcctacagaaataggtactatttttaatcttcatctcatctgaggaaaatgaggcacagaaaggtcaaggtaccttgagtggggtcacacagctaatgagtggcagagccaggattagaaatcaagcacccaaatcgtgacaacaaaggacagatggctcagaaggtcacccagtcttcaaactgtgtttgtgaaatccttttccccagctcacctggcgatctgtttaattgccgtgtgaaccatttgtttagctctcattcaacgttgaggcaaaactgggatcttggtccaggcaaagccccacaggaggatacgtcccccactacattcagggccttcctttgagcacagatgtccatcctccactcctcggtcctaccttacacatcgcctagggtgtttgaccctcattgttttctggagtttaggcttctggacaccacacaggccagtctgaaggggaatgctaagcacagtggacagtagaatccacctggtgtgctgcccattcattcggctgcagtatggccctctctgtgtctcccaggaaacactgaacagtggtacatcacccgccctgcgtatctctcccgatatctgggaactattgtactacctctctaatttctcttttctaggctgaatgacccatttcttcagcctcctctcaaaggcaatatttctcagcccttcagtcattttcattgctctcttctggcctctctccaagattctgtatcttgtttaaatagtgaagtccaacaccgaacatgatttaagaacagtcatgcctggaaaagtaacaaaggcccaacgaatacggactccagaaagtaaacattttctcaaaaacaaaagtattgtaatattaataatggtagtaagaattaggttgaccaaataaaatcatttttgttgcccgtcacatcatttcctcttattattttctagaaggcttaactgtcccctaagtcttctctgaaatgactttgctcctcctcaaaaaccctaagcttttttagtctcagctcttcttcccctcaacatagaaagcttatcatcttgagaaatggccgttctccttctctcaacaccagtttttccagaaatagcacttcctgtcttggcttcttcaatgtcttctgctttgggtaagatgtccccctgcctggctgcactgcttgtctcccctttgggtggatttcagcacatgagtgctcaccctgggggagggggaggacaggaagaatatgcagggcaggcaccacctgtgcagggccctgcccaggcccccaaatgcaggacaaagaccacccttcactgctgactcccttagtaattttttatttttattttatttttattttttggtcacccaggctggagtgttatggcatgatcttagctcactgcagcttcgacctccctggctcaagcattcctcccacctcagtcccccaagcagctggtactaccagcgtgcaccacaatgcctaattttttgtagagacagtgtctcaccacgttgcccaggctggtctcgaactcctgagcttaagcaatctgccgacctcagcctcccaaagtgctgggattacaggcgtgagccattactctcagctgggaatcttttttttttttccccgagatagagtctcactctgtcgcgcaggctggagtgcagtggctggcatgattagggctcactgcagcctcaacctccagttgagggttcaagtggttctcccacctcagccccccgagtaactgggactacaggtgtgtgccaccacacccagcattttttttttttttttgaattttagtagagacagggactcgctatgttgcccaggcaggtcttgaattcctgggctcaagtgatcctcccacctcagcctcccaaagtattgagattacatgagccactgtgcctgacccttagagaatcttgaggctaagaatcaggggtgaccctgatcaagttccacatgacaaatctctccactggccttgggagcaggtgggaccagcgactggaccttcaatagaggaagaatgacatcaagggcattttggtgaagagccaccaaagagatgtgaccaacacccagatgcccttgcacacagcttggcacttacctggatactcaataagcaagctggctttggtgccacttaaaaagcttaaccattaaaaactacagtataatgtagtataataaagaagaataaaggtgactgctcaaagaagcaaacgaaatctccctcccactcatcctttttctgggcagactaaggatgtatccgctccctgacttgttagctccattcttccagggaaggaaagatgagaaggctcaaggacagccacacacactacctgtccacttgccctggtctttctcacctccgccctcttggtccttagcaagctcctctggatcagcagctgtttcactgggtccttcaacatcttcaatggcttcttctgaaacagaagaaaaacatgtcaagggttaaaaataaaaagaagatgaaggacttttggcctctgttgcaaacaactgccaacgacagaacagacaccaatgactcgtcccccttctctttccagaggcccctgggagactgacggtgctaaggatatactgaggtctgggtaagcagtggggactttccttctgggtaaacagttggtatgaggttgtgactcgctccagatgtgtggccattaggtatttccagatagattctgaatgcttcgcttgagtagttctaactgaaaaaccaatcctggttgaagcagtaactccacctgaatccctgaagttgcatgcaagtcttttacacttgaaaatgcaaaacatggccacctgttcacttcatgcctagctccattcccaaagcctcctggtactggcctagaccagccccagtcactgacccctcacagggctcacagtgcctatgcatgtgccagagtgtgtgggaattgttggaagtcatgcaggttgcgaagagtcacagaatatcagtgatatgagttcatcagtttgaagagttccagaaaccaaatggtatcttgtgaacatgccaggaggcagtggtgggaagtgagatttgtagagtaagggataaaaatttgtaacagagtcgtacactttctttttgaagcaattccatccttcactcactacgggtttaaaactaatgcaggaaacctctctccagttcagtacacagtgctacagtgaaggcagaatgacggctgccaacgctaggctgcttatgaagtcaaatgtcgttcagccaagtggggaagaagagaataagatactctagatgctgagggaaagaaggggagacacttctctcttgctttcctggccctccgaaacattatccaaaacatgcattcagtaagagtgggctaagggaatgaataaagtggacaaaccaaggtgaaataattttaataaagatgaaattattaggaggctgtgaagagcacattttctcaggtacacaggcgtgagggcaaggatgcccacatctgtcagcagaccagaccccagcaaggaagtactgggtctggcttagaacactggatcaggcctctatccagcaccgccagaggtctgtccaaccccaattcaacttttcagtattttaaagtatcatgccttctgaccctctagaaaacagcctctaccccaatgctacttttccatttttctaaatgtcatgccttctgactgtctagaaaacagcctctaaatgtatctcacgaaggaagtaacaggagtacaaagtaaattggtctcaaagggtttctaaaacactgaggaagaagatgtctatttagaatcagattgtcttgactcaagagatgatggaggtccaaggtctggaaaactgaactagtgtcacggaacgttctttcttccttaccaccaagagggagtttatgaggcagtcactgggaatacaggtgaaatacggtactgtttattttcatctccaactcaggattccacatataatttctctgtctccttctttgtctcactgcacaataaagtcaacatcaagtttccctaccctacccttagttcaaacagagaaaaatcaggcaaccacagcttgaagtcaatcagatatagagccccacattgacaccatacatcatttagtagagtaaacatgtataggtgtcagtagagtaataacaaattacacagcgtgacacaggaactatcttcattatgtccaggtgggacgttctgtgcacatttttaggatttcaataaaattgttcaacactataatgataaaattcatctttgaatggtgataccagcgtgcggtcaatgaatattattgcattcggtctacccagatgagctaggtcccttaaaggacccttatttgtcccaatacatgctgtgatacaaaatatctgtagtgttgatacatttatgcctattgttccattattggaacactaagcttgtaggagttatttatatcctactgcccaaggtcatcgccaaggtctgatttttcacacacaaaaaatttgcaatctccagcataaatgggataatcaaatttgattaggcaaagagatggctcaatggcctctcatctctagtgcatacatatgaccaccttagatgaagacagtctgatacctacaaactacagaacaccctgagatggtgatgtgcagtgtctgaaggtgctgctcagcagacatgggaagggatttacccactggggggccatctccaagccagcacattatacagcctgcagctatcacagcagagcactaaaaactcacagtcacccaacactgaccccaattctttgagccttaccaaacaaatctgttgagaaactagagactgtaatgtataagcagatcattgatgcatcaagcatggaaactgcatgttgctttgtgaatattcctggagctctcattctgtgagcccacttgggcttttgctttcttccctccctgccctactgcaagcagaaaatgaaggcagctgagttccgatgagaggatcaacgaaagaggttatttcaagaacttattttgcttatctctttttttaaaaagatttacaaatcaagtcctcttcttgagttcctaggtttaatattatcatttgtgattcattcactaaaaggctgttctatgcgtggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagttacaccatctgtctttataccatcatcatcaacagcaagaggaaaaatagctctttaaaatggatgaaagcccaggctgacagtaaccggaaaactgtgagctctgaataccaataaaggtagagaaatgattaaaaaacagagatgcaaactgaaaatttgtctggacagctcaggcccacgatgctttgcaggcagggtgtgttttattggttccgaaagcataaagcaagctgcttaccaagagccaggcctggggaagggcttggtctcccggccctggaaacacgtgggaaccaggggcaaaatagcatcccgctttgaaacagagatctgcgtccacacgctaagctcctagggctgttatctagcccttgttctctttaggaatgtagatttgatacacacgtgctggagaatggaggggaggttttttgcttttccccccacagatcatggattgcattcccccctcttctgcgaagtcactggtaactggctgggtcattattacagaggctgcagatttttttcccctataatattagctactgacagatggtgggaacaagtgaagacctgatggactgatgatcggttttatctggaaaatcctgtctttcctacagaaaaagagaccaagacacataacagccactgtgccatttttaaggctgaaacagacaaatcaaaaccatcttctccttcaagcatttaatggtatttccaatcccaaccagagcacaccaggaatgctttcccaagggcgtggccaggacctgggagagaaggtcatccccactcccctagtcccgccctggttctgggcaggaggtagcaggcccaatgcctcccagacagctctgtgttttagaagacaccagagaaggtgtctctaaaacccatacggaagcccacagtagcctcaaactggagcaccccctcctgtgtgtgttttcatgttaaagagttagggaaataaaagcaaatactggaaaactgcagtgtcttcctagggtcccttctgcctttcatttccatgttcaacagtgactgaaggcctttaaaaaacctctttggctgggcatggtggctcatgtctgtaaatcccagcactttgagaggccgaggtaggtggattgcttgaactcaggagtttgagaccaacctgggcaagagagtgagactccatctctacaaaaaatgcaaaaattagctgggtgtgatggcacatgcttgtagtcgtagctaacttgggaggctgaggtgggaggattacttgagcccaggcagttgaggctgcagtgagccatgactgcatcactgcactctagcctgggcaacagagtgagaccctgtctcaaaaacaaaacaaaacaaaactctttccatcaccacctcctttttacaactgcttctcccagatagcacttacttactagtgcctggcaaaatccagcctgctcatcactcaggcttcctgactaagtgcagagccctgaagtgcaagaattccagcagataaataccttctaaaggggaaagcttcctaggacagcttcagttaaggggatgataccccagtcccagaaaatttcccttcaatcaaagtggttttgctgaccacaaatgcaaattgatctcttaatataccttatacttagcatcttggtaaaggtgactgcacaattcccccatcggtggtgaaatctgctcctgaaggaggagagcatgccaactggcagccccatgggaatttgcaccaatcttatgaacaacctggaaattggttcgcgaaagcagcaccaggcagaagccaaaaatagaggtggcatcaccacaaagccagcattcaaccccgcaacctcactgtatgcactccccaaacgcatcacccaagaaaatgttctagctgtttaaaaaagaaaaaaaaaaaggtactattttcccaaataatgggggccaagtgacgtgtccacggcgggtattctacgaatcacttataagcttgaaggaaggggagtcaatcaatgattaagactagtccctctgttcctaactcttaacaggataatgcagattaattcaaaccttccccaaacctgacaaagcccccatagtgcctcagtgtgacagaaatttggaaattctcctaagaatcagggtatctgtacccgaggctctcacatgatcatgttacttaaataatacaccaatctgtgatccccgaagaatgaaattgttctttcctttttctttggagggtgggatgtttgagggtgggggtgaaataaagtgcgtttgcctgtcggcaggctcaagagctgagaaacattagctgtcatgaaccacaatcaaatcaggtttgaaatatttagcagtggcttggaaaatgcggcggtgcagctctgacaggcgagatgtgcacagacacccactttccattataatggaaatatcaggcctgttctgaatatgtataacccagaaaaatgtattgatttttcattcggcattaaaaaaaatgaaatagcctgcagctgtcaaaagccttttgttaaaagctcatctttcctggaatgaggtttaccagaaacaagttttaattgtatataggacctcttctttgaaaaacaaaataacctatctgcttactttgaagatagagttaaagcttttcctttctccattttcaacctaattaacccaaggacgaccactgaagcaggtgggaaaggcggggtacactctgaccatcaagactgacacggaggatggcagctacaagtggcgtttgctggtgtctctgtggtgggtggaaggaaggactcggggatgtgcctcgctctcgttcctctaactcctgtgtaggtgcggcatcctgagactcattgtataccctgaccaatcacttgtcttctttaagccttggctggcacaactggaaaacgagggcagaacactctagcgtgtccaatcctcttggcattttgttatcaatgggaaacctctactggctgcaaatattctacagaatatgcaggctttattttgcaaatacaggtcaaatcaaatcccacaatataaaagatgactactaaggcctagaccacttatttcaaataaaatccagtgcgttataattctgctacaatagaaacttttaacggaacacaatctgcaatgctggtggacgggcagttgtgttgctcccagcttgttacttctactcccgtcttctctctctaagccaggaaggaagaggctagtggtggtaatctttgtggctacaccgatggaggtgggccactccctatgccattctccctctgtgactttcgagcaagtggagtctcatcgaatagtgaccacaagtcctgccagtgactctccatgagccccaagctatatcctacctgtaccgtgacagccagacccagaatgtagcaacctactctgcaacatcccagacacatctcaaatatttactccctggttttattccatggtgttcttccagccctgacaacctggctagatgcccgagaggtaacttccaagcgattaggtcttctgggtaacaatgccctgcctcgggaattttcccttaaatcaaggtggtttttgcttaccacaaatacaaattgttctcatcacacatcgtacactcagcatcttagtaaaggtgactgcatgttctcatgtatgtacacggaaaagggaatttgccaatctccatggaagtcctctgtggataatcatctaaattaaaaaaaaaacaccaaccaactttgcccattccatcttctacttctcagcagagtatatacatttactgaggaaaacgccagatcacaagaggaagggcctgggatccaaaccagcactgatgagtgggacatattgagctaactaaccctatggtagtccaggcaggaaacctcgaaggggtgaagactgagtgcagatgtgtgtgggagggtgggggcaggagaaagcaggcaggggctctacagctggagcatctatttactcatcagaagtgtaatattttcccaccttctcaggatgtcatttcttttccaatgggcaaactccagcgcatgaataaagctcgagacattcatgcccatttgctctctgcgtgtatgataagcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgcccaggctggtcttgaactcctggcctcaagtgatcctccttccttgacctcctgagtagcagaactacaggtgcactccaccatccccaaataattaaaaaaaaaaattctagagataggggtctcgctgtgttgcccaggctggtctcaaactccccagctcaagtgatcctcttgccttggcctctcaaagtgttgggattacagatgtgatccactatgcctggacctacaaactctttttcacatggatcctttaagtaatcattttaccacaagaattctttttaccactagatggtcatttaccaaatacacctggggccacagcgcctggagtttctggacagcttgaaaggtggtggagagctgccagcttccaagggggttgcagcagggaggccctgcaggaaaaccccacactgaaggaattcagcctccttaccgcccccaccctgaccccgttcctgtcccccattaccaccatccctgttttttggcatcaggctctaagaatcaacactctgaaagcaactctgggtattattaaaaatgactaattggagaatagagaccatttatgcttttgtatatttgaagatcttaccactgtttacagaaacaagaaaaatggggattgtgtggcaagaggcagcctgggaagggagggccaggctgcagctgcgtgttcggcccctgctgggcagagtatggcccagctcaacaagaatgcaagcctgggggagcctctccatttgcctttttactttacctcacctccaacttgagcattgacaggagagagcctgttacgagtccaaagtggccagggcctattaaggcctccccgagaaaatttcccctttcagccgtccctcctgtgggaacagcacagaacgccagagcatgaagtgaaaaatgctgccgttgtgtggtgagggacgggtcctgccatttttcctctcccaggcaaggccacttggccatttgaacaatttgtcaaaaccgcacaagaattacgggggtgggtgggggtcaagagaggagaaaaagggaggaaacgcctagagccagtattgcaacaagttccatttatctgtgttcttagcaaaagcacctgggttgccccctgcagaaatccagaaaggataaaagtaaatgtgcggtgacaaagcacaacggaacgaaatatgtcgcggactcgcctggtggctattcacaggaagattttttttttttttaataactgaaaggtgtgagttccagtttgtaaaatacaaacccaaccctgaaacgctctcggaatacacgctaagtaagaaagctagctatgtcccagaactctgaagtaaacggaattcagcagggattagttcccttggatttctacagagccatgattgttgctgttactttcacacatgaaatgtaaaaaaggcaaattccccgagcatgtctgtagcagagcgtgatgtgattgtgttgtcatttatgggaaataatcgcaggcccatctctcccttcccccccccattttccagtccaaataaccatgaaaaattacacttcaatgtcagcgcgacgacaaaggaggcgcgctctctgggagctcagcggatttgcaggggtttttcctttctttggacaaaaactaccttcaattgtacttcatttaaaacgtgatctaacaaatgcattttgacaagttcctttctctttttctcctttctttcaaacagtattttacacagtttaacctcacaccaaactggaatgttctagaaagaaggggcatgcaaaatagaaggtccttgataccaagaagggtgtcccccatctcgttaaaaacaaaggagtcaagaaaaatgattccaacccagtatgctactgagaaagagaggaggatgagagagaggaaacagtaatgtcttaaagacagaaaatttgataaagccccaccccccccaaaaaaaagctggagttgatagaagaaggtctcgatggagtatttatttgctcatcagaattaaccattttgtggattcagaggcatcatctagggtgtctagatttatggtcagaattgggggttcatgacaatgtgggggggatgaagaaggggagcttccctgatggggtacccgttccctcctgtccccttcctctgtaggaagggacatttttcaacagagcagacctgcctgaaagctttttaacattccaggtgtgaggctgagcagtccctacaagcatctgtctttcaataacaacctgccggaaataaacactgccaggtttccatgctgggaggggagaagacaagacagataaacacacatgagtgatagagagtaaattaaaaaatttaacagtttccattaaagaagactggtatctccttctgaatcaaaactgacttggcttgtcagagagagatcttatgcttaatgcaaaaaaaaaaaatccgtttccttatttatttatttttaattggaaaatactggaaatatatggatgaaaaaaagtcaaggagggcctgtaagtgtacttaagcatctatatacaaatgaaggtgtatgggaaatgaacaggatgtaccagaactgatattaaatgatggtgattagaacctaatgggcataagtgaaaccttgtgggatggctctcgtaacaggagcgtcaacggtgatggatgcaatctatacaagaacgacagccagggaaggagagatggaggggcggccatgcaggcccaaggcatttgcaatgctggggagacacagtttgacaataccaatgggaatgacggactatttggggcaaagagaagcaaaaaagcaaagagaaaaagaaagaggtaaacattttgtgtctgaccatcgaaacaaatggcacacaacagagaaaaataaaaccatgactccagaggtctgagtcacatgaggatacaaatgagggacttggattccctgtttgccaccttactctgaagcccacagcgtctgaagaatctctaacctattcagaaaacagcttcacccttgcgaagcacagaactcaggcagaaatatgagtttactcccaccagtggacagcagaatgaggaactgactgtcaatgagctttgttttgcatgatcataagccactaatatgcacagctggtaaaataagctgattcataaaaacaaagcacaaacaaaaggcttacactttccaaaccaaatctggggaacagaaatcaggccagcttgaggcaatgctgcacccagaaaaacaccagctaaatctgctctcccttggccagacccaagcatatacaaaggtcactacgtatttacaggttgcacattcaagaatgcaatgctagaaacgtgtgaacacccggagtggccaagaaaagacccttacaactgcaagcatcgtggggagccttcaggtgcctaccacgagttccctggtgccagcggagaagagcctaactctgccagaagccagacccaagacatttcaaggtgcgtctacacgtggaaagtcaaaaactgggctactctccaaaaaccatccagtccccaagcatgcatcagtttgaaacaaacaggcaacagaagcaacatgtttcagttgacatttcctgggaaactgcaaagaaagtgaagcaggaagctgaggtacagagaaaatccaaaggtttacgttcaagagctttcctccattaatgggggaaaaagcagatggaattgctaacttgtcatttttaataggcaccttgtacagctattctgtgtccaaggggagaaagaatattggatcctcctcctctttagaaacttagaaagtgatgccagtagttggatccaaagcctctgtttttttaaagtttggatcctgtacaatgaaacggtcttttgctagggtttaacaaaatgccacccccacatccctttcacaatgattttagctacagcagcgctcctcaaatctcccacagctactaaactgccctgtagactcagcctcaggactcgctgtgtatctatttagcttttcctcctgtgaggtgtttctcagacctaagaacaggctagcaacccttgaaaagcaatacattccattccacaaatgtatacagcaatatctctcaaggcccaaaaacacacagtgatagtcatcaagacaaacacttgaacaaaagtaatttaaattctagactcacaccccatcctgtttagtggtgggaatattcgaaaacaacaaatacatgaaacctaagagaaagaaaatgttgccatgagatgacaaagtcatcagggatcgggcagaaggtgcagtttagtgacaaagagttggtacttgacacagaaataagggatctatagaaatttgtagcacacaattacattttaaagaaataatctgggatgctgagatccttccgtgtacacactgcagttggcggaagcactagaaacccgctgacagaaaaatccttacttcagacgtccccaaactttcataagtgagcaacttgtttttttgttttttttttcttttttctttttttgagacaaggtcttgccctgttgcccaggctggagtgcagtggcaccatctcagctcactgcagccttagcctcctcggctcaggcaatcttcccgcctcagcctcccaaagtgttgggattagaagtgtgagccaccatgcccagccagcaacatttcacaaagtgaaatacagaaactggacagtgagagaataaggaaaggaaactcgaaacaaatgaaaggttatgcttcactttgtaaggccaagattttagcaaagaagggtaaaacaagccagaggtgtgaagatgaactaatcaaagggcagtgcaacactgaagataagaccgtcccatgattagaaagaataaagtaagtgattcttcacttaccaagcaaaatcttcaaataggaggaggtcggaggaaggagatttagatggcaaccaatgaaaactttcaaaaaacaaacccaggtaaggttatatcttaaaattaaatatatattatggtaggaaaaaaaccggatcaatttctgttaagaagagctagcctatgagttgactcaactactaaagaactttgctgaaaggttaaaaagaataggaaatgttccaggagaatggaaattaagacagaaaacagccttgaagacaggtaacttgaagaatggagatatataagcaagaaaagataaaagggacattggattaaaaatctacctgtgtaaaatttagctggatacaattaggatggcaaaagcagaaatttcttaggtgttttagaaaatataaaaaggataactaggcagaatagtccaaacacaaagagagcataaacatgaggacagcagatctgggaaggaggaatgaaggctgttcgcaaaagcctggtcaccggcaggttctacctgtgttttgaggtatttgggggagctgaccacaagtacctcaattttacagactaggagaccagggattggagcaggatagggctccaaagccacacagtggggccaggcacagtggctcacacctgtaatctcagcactttgggaggccaaggcaggcagatcatgaggtcaggagatcgagaccatcctggctaacacggtgaaaccccgtctctactaaaaaatacaaaaaattagccgggcgtggtggcgggcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaccctgctccctgggtgctggctctgcgggaatcttccctccatcaaggtggtgatgttgaggcaggtggattctaataatggtaccatagttgttcaaagcaatgcctaatttttctttacagtttaagacaaatggcatggcaaggataaaaaatgaactcaccaaaaccaaagcaaaccccacgatacacaaaacaaaaccagccaatcctgtttccaggcacctggtaccctgttaacttcctgcccagtggcaacatgaagccccaaataaaagcatcacatttaaagaaaggacaagacacagctctctctccccctctcctacatccgcacacactcacccactcactcacatactcctcccctccatgctcttttctggaaaggggggaatcccagaagtactgctcccaaatggcttggggcagagctcatcatcgatattctggatcagggtgaggtccaaggcactgctgacagggttgctgtcacagccccgaatcccagccacagagaactagcaaaagccaagtaattgctttttccccttccactaataagcttttcagcagaggaagaattcagcttcctgtagtcaacagacccttttttccctgcctctcctcgctccaaataatctaaagtgactgcaatttcagtcctggctctccagcattcagctccaatggctgaggtcagagggtgtcaagtgagggctctccatttcttttctactctgccttcacaccgcccatgtttctttgtaactgaggcaacctgcctccctcgcccaaccatcacatgcacccccagcacacagcacacagacctcacattccaggaaatgtattttaaggcccaaaacacactggggctcaggagtggtggtgggggggtgggtgtccctttgctgtaaacaactaataatgactgacctcagatgctctggtgaccagagcagctgatatccccgttcttagaaaatgcaccgcagcaggacattggcttagaggtcgttaaaccatgtggctggttgtgcggtttttggtttagttttatgcaaatgactctggttcctaaattcttaagatcttgctatgcatttgtggcattggtatcttcaggcctggctctgtgtcgaatgagaggcaagtagactgccccgaaaaccctgccccgccccctccccttcctcatttccgagatgaatgaaatgctatttcaattaagtcctgtagtaacagtgctccccttccctgccttcatagagagctaagccgagagcacagacagaactgaaggtgaacaaacaaagggaaatggaatgaatgagagaatgaacaggtgcatgaggggaacgagggaggccccggcaggttcctgctcctccgtgtggcggaaaagagggcaaggtgcggacaccagaggcttgcttctggaaaagcagctccaagcgggggaaacagaggcagcactgcggagatgaggcacacttcttcctccccctgcgcccagtgcttgtgaaggtctggaagggaaggaaagaaggggagatgcacctgagaaaacactggaaccccctccccctgccaccacacacacgcctagaggacgcacactcctggctgcagcccggcctgtgatgggaatttatttccctcaattatgtgctcttgtccccagtctcagttcatcagcacagtgcagccaagtcaatgaaaggctccataatgaagtcatcgcatgcacagggacatcccggcacctgcccgctgggctggcagggctgcagccacgcccggccctgaaccaggcctgcgtgggctctccgcccccaactcacatcactgccccacgccacgtgctcccacgctctgtgtcacggcacccccgtcctgccccaggagcctgtgttctggctgccatcttctttgccccaatcccaaatgttctgaccgcaaagcatctgtgacccagaccaatcagtacaaaacactgacgactttccctttctcctgcctgtgtagaccccttcaccaccaagagcctgatcacaaaaaccaataccacgcgcctggaaagcctccattggcttaagtcattagcaagtatctaacaatagcaacacaatcatcactcagctgaagtagatagtattaggactctcatttcacagatgaggctcagagaggttaaattactggtgaaggtcacatagctaggaggtgacagctgatgccaaggaccatatgcttaatggctacctctagaggcaccaaccatggtggccttcacaggagaacacacacttgtgcttgtgctgtctgtccatccatccgcccacccatcacatatccatgtggcacctaccccaggcattgacaacacggctgtgaacacaacaggaaagcccctgctctcatggggcaggggcaggaaggagtggggagagtaaaacacagtaagcagctcagtaagtgagcatattctaagtcagaggctgctaagggtcaacgataaagtagaaaaaggaatccagggagttccttaacatgggaagctcagagagggtggcatttgcacacagacctggaagaagtgagagtgtgagccacaggaggctcacatggcagaggcatggcacgtgcaaagacccagggcacagaaggagggctggcctgctggaagagcgctgagcgctaagcagggagagaagggacaaggcaggggataagctcagagaggtcttgggcagcatcctgtaggccttgctacccactgcaggccacgggcactgtgagcatgaaaggtacctttgagaaagtcagaacaaggtgctcctccagcacctcttcctctgggcacatatggtcctgagacccaccactccctctgctgggtaaggtagtgtctgggatggactgcagtctttatgcatcccccttagcagagaactgtttgtgtgggggacaacctgcacggctttagctggtggccccggcagggatttccagtagaaaaactcctgtctttccctaaacatgcatgtgcaatatatcagtgcagatacggatgtggctgcagatacagataaaatctctttgaacctttccatttactgggggctggcaggggtgggggtagagctggcctcacggtgaagaaacacaaagaggggaagcggaccagtggctatcctttgccatgggcggtgctgcagcacttggacagtctggacgcccataaaccaaaggacccatctgaccatcgtgctctgaagcctctccctgagaagaggacagggcagcaccaagactggggtgaaggactcaaggctcagaatggcaaatgcagaaattagttactgcggtgcaaatgcagaaattagttactgactgttctgcatgtcccttctatggaaatgcattgtccctgcacctaaatgtatttcagtggactttgtaaatttaaaagccatagaaaactatgtgacctcggcagggctattttaagctagcacttcctagtacaaaatgaatttggtattgaggatgaaggggggactttatttttctcaaattggctgttgtagaagaaagtctgctcaactcagcactacctaagacgtgtctccccctagtgacacgcagacctctctgctactggtgccaccaccctgcagtctcagggctggagcaaggcagctaggtgcaggcaggcagcattagttctgcaggctgcatctggccctgaacctaggaccagccatctcttggtaccctgggagctccaagaaactcagtggtcaggccccggagtgttccaggttttgctgcaatgttaagaagtgagcccggagcacccccagggcagctgatccacacacagcttccgcagccaagggaaaagaggggatggatggaggccaggataaagaaggggaggggtggcaggtaaagggaatctccccagaggagtgaattcctttccaggcttgctggggacccaacagggacaccccaaaaggcaaggcctaaagccagagcaaaaacaagcagacgcaaagcaggggagagtaagcgatgggcgaagacataaaagcccaaagatgagagctgaatggaacaggaagcaaaccagggccaaacccatcacggcttaaagcaaacgttaatgtaggttccacattgatctgaagcccgagggggaggaggctgggtgcagccaggctcctcccctcctccatctcattccattcacatcatcaggagaactgtgttttggggaaggggtcaggacaatgattggagcctgaacttagctgctgccttttacagtagcttcccagaataaactgccccaagacttcatccatcaccaaaaaaggcaactgtaaaaacacaggtcgccagccccttgcctcacaccagcacagtggccctccctccgctcctggggatgggggtgctgagggggaatggagggcaggcgctcaggcctggcactaattgctcttggggatgctgtgtggtgtgggggctgttccctgcgctaagcagttaggaacttcctaaatcattaacctttctcggagcgcattgtactgggaggtgctccctctgcagcctattcacgagccctattgatctgccgcacactcggtgccttcaaagttgtttatgatcaatatgcaaattgcccatggcattgatctagtattaattttcaattagggaatccacaaggggtctctgagggtcaatacctaacaatgcaaaggaaactccgctgtggagtatcaggcctgatgctgataaaagcttcctaagcctcctcctcaacagttccaggccctctgggctgtcaccttcactgtggctcatttggttccctcctaagtcagaccccttcggcggcctcccaggctgggtctgcggccatcaccctgtgccccccctcccaccccctatgccactggaacacctcctggcctgccagtgcctgcccctcttgcccgccctcctgatcagatgcccccagacatgcctcctcatctccccatgccacgcccagacccaggaccactctctcccccagctccccaaccacacataccttcttcctccctctttccctttccctcgtttctgcttagtcacggaacgtcaccttggcatgctgccacggctggagctggcgagctgcacggtccccagaaatctcaggcaggcaggcagagcgccgggctgccaggttatgcttggcaaacaacccactgatgtcatttcaaaaaaccaggggggaaggaaaaaggcacagcttcaaatcatctgtttctccttctttctttcgtctagcaaaatttttcttcctaatgaagcccgggggtgggggatgttaattactttaccactcactcatggttcccagaagaggccaacgcccgccctccaggagcacagggcagtgcgtgtgagccactgacggagagtgtccctggggacagtgtgcccagctgggactggaatgacccgggaactcagtcattccatttacgcccctaacagcccctgagagacttgcgtgggaaagctctgcagccagaggagctgcaagagaaaaacgtggcttggtctcctcccagcaggtagggggacaaaagcagggctcagccatactccagcctggggcccagccggctcagcctgacttctctctctgccaggaggttgaaatgtgcttacgtttggaataaacctgcctgaagatgaggccacgatcctgccaagatggtgcccacgatcctgcctaagtcccaacccatgccctgcccactttccacactgccactcatggcactaaccagtgcattagctagccaggctaataggtttatggataacattaattaccacgttcctcattaatggatgaaatctttattggtgccattgatcagcggacttgttagctggcctcctaaccaatggcggatgtaacaagcgttcttattggcatatcaattaatgcaatcaattcctggccaacggctgccattcacttccctggttgttcgagagtaggagacagagccctgtcaagagtgcctttacttagagctccagctctcagctgacttccaggtgggctctctgccacttggagttcacctaccaaaaaaaaaaaaaaaaaaaaaaaaaaaaaaaaaaaaaaaaaaaaaaattcacacctacccttccatctgaaaatcacctttccgtgttccagtgatgacaaaagtgctaagctacgtcaggggacataagctgaaagaaaaggtgggaacggtcgggggactgtcagagcaaacaagaggattagagaaatcagatgtttctaggttaggcactgatagaaatgattcaggccccagactggactagggacaacactccagatgggaccagcctgaaaacacaagccacagccatcatcagccctctgcccaccctggggaagccttcctgaccccagcctccccaagccacagtcacacctactgtcacacctacaaagtcacacccaccagtgtctacctcacttagcacttcagaccacaggtcccacatggaaacatcacctgcccatcttcactcctacgcttcagtacggaaaaggacttaccacaggacgaacgaccatcccactgtcactaccaagtgtgcagtaaatctgtgcacacaagtgctattttcatgtgtgttgaaatacacatagtcaatcatttcaacagcacttatatcactgtagagtcgaagttggggaaaaaatttctctgggcagcgagaagtttttagggacattgattagaggaggctcaaggaactggggatatagggtgggtccacagaaccatggaccatggtagagctggactactgatgaccagtgatcaccagggcattaacaccagagcaaagaggccgggctcgccaggcccacagctttgggaggaaacgtggaggatgcctccccctaagatgtgctttgggctcaaaggattgactggagtttgccccagatgggagcagcttgaaatattattccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggttggggggagaaagtagctttgggccaagtggtgacagggcccaggagcctgactgaggctgcggtgcagggacataattctcagcgtctgaaagcatggctcggggtttctaggataaacagcagaaatatttcctttcacttataaatagaaagtgccatttttttccacatggaacgtcatcacttccatgttcacagtacggaggagaggagagtcctgagcagacagggcagggaccagagagagatgccccagccagatgttacactctcagggtggggaccaacagataccaggaagaagagggacaagaggcctccaaggggaggccaagacctctgcaatccacgaagtgactttacatgaaacaggattgcacattctatgcaaaggtcacccaatgtgggtgacagggagataccccgacaaggggctcttcatcagccactcaacaccacggcgagtcttccagagagagtactcttgggttcttgcaacggcaaaagtcccagtgtacttctgactagagttcctacagtattaatataatggtgtctaaattcctctctggggagctcccaaataccacaagggttctgcacattttgattccaatttcacttttttttttttaagatggagtctcactctgtcgcccaggctggactgcagtggtgcaagctctgctcactgcaacctccgcctcccgggttcaagagattctcctgcctcagcctcccgagtagctgggattacaggcccctaccaccacggctaatttttgtatttttaatagagacggggtttcaccatgttggccaggctggtctcaaactcctgaccccaagtgatctgcccaccccagcctcccaaagtgctgagattacaggtgtgagccaccgcacctggcctcaatttcatttaaaatgctgtaataataaggcatgctcaaatgtgatatatgccaaaatttaacacactggcggccaggtgaactagttacgtggccaagttaaacagcttttgcgtagactttagcataaaacttctgccattttcacttaatggaagactcttctgggattgcaaggcaggctattaaaaccagtcctgtttggaactacttctgtatgaaagaggattatacagaaattgtctaaaacaaaatatagaaacaaaacagaagcttagttgatactatttaactaccttccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttcctttttttaaaaaaagagggagaggggctacttctgttctctgtaatgttgaatgctcaagagtggcagttgataacctaaccagacagaacgctccccatggtagttttctcctccaaagaaaagagcttagaagctttctctttggaacagaagagtcctctattcctttatttgctcactaagtcattagttaaactatccgttcatgcctcctaggtttcagccattctggatccaactggacaagtgagtcacaagcctgccctcatggaacttaccctccagtagatccactttaggtaacataagatggctgtgttatgtccagagctttctcattgaaccatcacgtcaacatgtacttggacaagaaaatcacctctttgactctgtttgctcacctgagggatgacaaggttgaccctgggtggtctaacagggccaccatgctaaggctctaagttggacaccttcaatactatgaatagcaggaattgttaaagaattaaaccccacccactctaaaaagactgtctgatccaggcttccctgaatcttcacctgggtgattatgatcaaggttcttctaccaccaaacacaataagaaatcaaatcttatcagaattgagctataaatctgtgaagactccaataatttctagccaagggaataacaccacaaaagtactttttaaactaattactcagattctgaagtgctgccctaatgagccttctttctgcccagaacttactaagaggaaaaactaccttctggtgcagtaattactgctttccccttcaaacttctaactggagatcgatgctgcattttaagacccattgatttacaattagcctggctttcctgctaaagtgttttttaagcagagtttacttttattttattttgaaatctctgagatctggttcttggattttacattctcatgagaggagactggaaatctcaaaagaggaaggtaggcattggaagagagggcagtagaaggatgcaaatcagattcaggagggcggggaaggaagaaaaggaagttggtttggtcacagaattttttttttaaaagccaaaactcatgctgaaagggagagaatgaagaaatccaaagagaggaagcagaaggctgagcggcaggaggagagagctaggtgcacagactaataaagtgtagctgctgtcaaggtggctggaatagctctttatggcctccgctgtttattagcatccttgagaaggaaaaaaaaaaaagaaaagaaaagaaaagaaaaagctttgtgcatctttgcaaaacaaagcactagttaaaaatagtgtatgcagcagggacagtgtgctaacatgagggtcctggcagctccagcatttgcacaatctgtcccatgaggagagcagaagtaagcgaagcaattaagaatttcatgctgattgctctaagcatgttttctatgccataaagatactagcataaaggatatggccttgcttctctccctcccctgcctgctaacttttgccttctagcttttggacttttccttttctttgcctcccatgtttgaggattcgagacagtggttagccggcctggcaccactttatggaatctgtcacttctataccgaaagaaatggcggttgtgtgcgagtctctccctgcccttgatcaagagcaaatctggaagaggagatataagccaagctgcattactaaagccctaaagagggaaggcttaaagaatggggaaactccctctgaggcctacaaatccgggctctccaaggcccctcctgccactcccattctggctcttcactatttctgggtcccaagaacgactggcagaagatggtcctggacaaatgagagcaaaaagtaaaaattcccaaacaataaggggggagggacaaaccacaaactttttgcttttttaaaaaatgtattttatagcaagattggataggccaatttcaaagactaatatgaaaaaagtgcaattaaatccttgaaaaactgacagatcagcaaaacaaaaccacccggaggagagcccgattgagcctcattaagagggagttcagcctgtttttaaaacccttcttaacacttagctgggtacctcccagcagtgcgcactcccaatgcggctggcataattagtgtcaaaatggaaagaaaaaaaaaatcaacctaggaaatagaaattaaaacacaaattggtgggtggggggggggtgtcaaatggaaaaaacattccaaattcaaacaacaaactcctatcagtccatctgagggcaatggggagatagcaaaatactctactgtacgcagagataaatacgttccaattaaacagagagagggctggggcagattgagaagatttatgctgcaattccccatcttcaacctctccctcttctcccaaaatatattctacattgtggtcacgtcaactccacaaggctggggttaatggcagatggatggcaaattgcaccaacctcatcaattataaccatcatgcctgacaatggggaaaatgagatctggtgacaaatttccacaccttcagccatcaggatcccccaacgctggagcgcgtgcacgcgtgtgaaacagtgtgtgtgtgagagcatgagtgaatgcattacatatgaaaccaccagcctgtaataaggagatatggagctgagacccattatagaagggcaggccactaaggaagaaatactctggagatggaaaagatggcaggcagatgaagccattttattaaatcaggcaaattctaattcattctgcagagacagaggaacgaaaacggattcattctcagtatatcctctgagccagctcttatcacctcagcagagggaggagtgaaagaaaggttccaagattcatctggaaatcgagagaaaccttcccctttaaaaagcaaacattaaaatatatctatttcaataccctgcaccaggaatatggaaaataatgctcgcgccagagaaacgcaggggtccttctctggctttccaattattccagcacgtgaagaagcttacaaatttgactcattgcaataggaaatcagaaaggcaactgcagcctagataagttgttgacaaggactgacaaaagggattgtggaacatctcccccaatggcaagaaacgccaactgccaccttccccgtggtgggaacttaaatgtcgattttctagttgaaaacagtggaaaagaaaggccgtgtatgagaacaccaagcacagaggttgcctttcattaacaaaaggcgcttgtgtttagactgcaattagaaaaccaaggttttaattaaacaattacataaaagttagtttggctccctgtatagtccaacacttcaccagcgccttggggttagtttagcaatgagtgtttagagctctggctgctatgaaggggggaaagaaactgatgacacagcgtgcatgtaactgtaaagctaggcgctgtacctgtctgtctgcagctcccctgccatgttctagaacaaaggaaaagccaatgagactgacaatgagcacgcacgtggtcagaccacaagccatcagtaacatcgtactactcatggctgaacagaagagattattcaaagtgtcatgcaagacctggggggctcacgaggcttccggtgttcccaagtgaagagctgcgtctctatcaaagcacaggccaggtgcagctagcttactctgtgcctcttttaactaagagggatacgcaggagcttagatgccttcaaaatcccaaaccacctctgggaggagaagaaagcaatctactttttcacctgctgcttttacaccacctggagacagctgcccagggcagacagaggtacgtgtaggtccaagggcttagattcctaggggagacttcaatgtctaatcttcctagcacatggaaaactcctctgtggctcccagcaatcatcaacctcaatgctcaagagctgcaaaatgaagtgaaattagttcttccctatacacatcagctttgaagacagaaggtggccaccttctactaaaccatgttgcaggaacagcctgggccatctccacccttggtgaaatggattgtgtcaagtgagtggggcctggcttataaatacagacaggaagattgatcagttttcactccacagcacccaccaaaagtacacagacctcaaaaagcaaggccattctgccagtagggcagccagtaaggagaactccacactgacacccgcaggtgatgcttcagatcacacctccacaggagctaaatgcagccttatgtttccacaattccacattcccctgccttcccacctgcttggaattcttccagctctgaaaagacccatgtcaaatgataaagaatccaagatgggcagccagttgatactgaccaatggcctcatacattgcctagcactggactatcttcctaggcatttctgatcaagtcactgaaagaaaacctaaacaacagagctaattggttggcaagatgctgtattctgtataatacccaaggctaaccaaatcacaaggtaatcagtatttgttagttttcatagaggaccagccccatttgggtttcacaaggacaggaagttcctccacctacagagataacagaaaaataaaaaataaagactaagctgagtgtggtggctcatgcctataatcccagccctttgggaggctgaggcaggaggatcacttgagcccaggagtttgcccagcctgtgcaacatagcgagacttcatctctacaaaaaataaaagtattagccaggtatggtggcacatgtctgtagtcccagctactatgaaggctgagatgggaggatagcttgagcctaggagtatgaggctgtagtgaaccgcgatcgtgccactgcactccagcctgggtgacagagcaagatcctgtctctgtaattgacaaaaacaaaacaaaacaaaacactaacaaaacaaacttaattccaagttaacaaaagctgaggagttattttttcccaacttcaggctgcagccctgctaggtttgcaaagaaatgggaaatttaaggataactctgaaggttgtataattcatgccactggttctaaaaagcaaagttgccttccccaccaaaatccttcatctttcagacaaaggcagggttttcttgccgtttccaacacctgacagtgtgaactaccggagtaagagagcaaggaccagggcccgctgctcctcagcctgaaaggcggggcagccaatcagaactaatctctgtgctggaagtaaattcagtgttctcttccctgatctggtgcggcggggggctctgacggcaggggtgggcttgcttcccttggtgcccccatcccataccctaaaaactaacaagggcctttctggtcaacacctctcaccacaagcagccgtggaagaaattattttagatcaagcccaaaatgaaatccaaagcaacgaggctgactttatgacttatttatttatttcttccttcacgaacagaaggttaatataagagcaactccttggcaaacctttaagggtaattcaagcgacactgatgtgaatcaatgttccctttgtgaacacattacttggcagaaactggctttttgtaacccccttaaacatagccggcaaaacaaaaagaggggggaaaatgtccttcaaacaaaaggatgaggtgaaaataaagagagagtcgactgcactttattctctttcatagaagcaaatggatctggtgcttttatacattaatcaatcaatatcactggctgtacatcagcagggtagccaagttatgaatgacctttctggcaaagaggacacttttaatgctcataagactgctcatagcttagcaactttccgaatttatgcctgcatgattaccccttggaggcgagcagccgtgagtgctgcactaaatatggcaaggttagtcgttttcaatttgtgcagagggaggaagagatgtggacctggctgccccatttacgcacgagctgccgcaacctgggcgacacagagggcagagccccaggccctgcagcgggtcagggctggcctcccttctggaaagccggccgggtctcctgctcagcttcaggccaaaccaaacacggcagcttcagacagctcatctagaaagctgtgcccagctcaacttcgctttctgtctgcttctcacaatcagatcctgagttcctcaagctgacagccaggccggactggccagcacggggtattcccaggctccctccacaccctctgccctctggcttctgtgcctctgaaagccctccccacgttgattggactcctccaaccaggtcacagcttgatgtttccaaaaagcaatgagaactttcatctttgttttttctttttttaaagcaatccacagaagggcatttctaccgaaaagatgacgctctccagaaacaggcagcccacataaacaaactgttgggccaatcctctttcttttcccctgtcaccaactcagccattctcttcatgtccaaaaggcgagaaagttctctggattccattctttgtgggtggaaatggggcaaagggttgcctgtgggtctggatttctatgacaaccgctatcgtcccagagaggccgcaagggggcaagagacaaaatcccacctcagccttcttctcccaactcctcttttacagccatgtttaaagtctctggaagtctggaagagattcccaacttggacatgtggaagtccacttataaggccccacttttttctgtctcccatagagggaaataaagacgtttagggatttgaaatatagctttaacttcatataaattagaacagaagaaaccacaggctaaaactcattggccccactggagtacaaggaaaattcagcgcagaaacgagctttactgagaccatcctttagtctacaaggagttgcccagtgaggggagaatgcggcaggacatgggttagaggaaatgaacagctgggttgtggtcacttctggtaatggccttaagaacacaattgggccactccgtgttcatatttctgagatcagaagagtttacagaaacaggactccgctccaaggtatcactgatagaagcccccaggccgtaagacaggctagtttacagaaatggaagataaataacaatgaaaacaaggagaagagaagcttgtaaggacactatgcaggcatctccgaaggggtggcgagttcttatttccgtgcccctcgacatggtggacgtttgcagctcctagcccagctgggaagtacaacactccctcagcgttccacatacttaaataaataatcctggtctcgttaccgattatattttaacagatccagattcccatctagaaaaacggctttctgtttagagcagggaggaaaacacagagccccctccagctggtccccctgcagagctggttctgggatggtgccgcagacacccgcttcctgttccatcaggcctcggtggaacggctctgttttcccccaggaagctccaaatccacaaagtcaacaattcttaaaagcctgcccgctttcccccctctttcctttcagcgtttaacaaatatcaaacgtgtgtccctccaaaccaccttccaaatttacaaactttttactttttgagacagagtctcactcactctgttgcccaggctggaatgcagtggcacgatctcagctcactgcaacctctccctcctgggttcaagtgattctcctgcctcagcctcccgaggagctgggactacaggcatgcaccaccacgcctggctaattttctatttttagtagagatagggtttcaccatgttggtcaggctggtcttgaactcctgaccttaagtgatccacccgtctcagcttcctaaagtgctgggattacaggtgtcagctaccacgcccagccaaaatttacaaacttttaggtcccctttggagctgccaccctatggaccgccctcacagaacacaacacctcagggaaggggttggctaaatgctcagtcgtctgtcctttctcgatctttgcgcaagcctggctgttcctctgacagctctcaaaaattcatccctggtctgacagttaaaaataatgcatttattttttgtgtgcacaacggtgactttacagcctcccagggttttcccaagttacagacaccacttgccaccacttttcttcatcttctcttacctggccaacagcaacgggtcagcagatgcttttctcacgcaccttccctctcccatgcaaatgactccctaacccgccatccacctggcagacacctgtgtcccctgtgctgtgttgacatcacccttctggaagtgcttggtaccaactgtcccctacagccactgggctgtcttgtcacacattgccatatggcatgtcctcgttttgcatatttaaatcgctatatcaagaatattaacaaagataaaagggtatgagatcttcccactaagcatcgggtggaaattctcacattagtaataatgcaatgtgaacccaacccccaggatggagaagccactcagaagctggccggccatcctgttttgggtgcagtcccagacacaaggacaagccctccctgggaggcgggttactcctcagagtctggaaaaagagactgtttccccatccacgtgcacatttcattacaccagtgaatcctgatacctgggtaatttcaagcttttaccagagcaagagaacaccctaatacccccaaggaagccccaaacgcctcctggaaaaccagagtccaggaatggaaaaatacatcagagaaaaattctatctgaaaatgtggaattaccaacatgcaaaagatgccagaaccagaaagcctaacctgaaggtccacatattttgtaaaatttgcacaagaatagatagaacccgctgggcatggtggctcatgcctgtaatcccagcactttgggaggcagaggcgggcgggtcacttaaggtcaggagttcaagaccagtctggccaacaaggtgaaatcccacctctactaaaaatacaaaaattagccgggtgtggtggcatgagcttgtaatcccaactactagggaggctgaggcacgagaattgcttgaacccgggaggcagaggctgcaatgagtcaagatcatgccactgcactctagcctgggcaacagagcaggactccatctcaaaataaaaagaatagatagaactggaattttctgtttcattgtcggtgtcctctgctccctgagaccatatgctctgtggggaggaactgtgtgacacactgtataccatgcaacttcaagggaaatcaatcatgttaggccactgctgaatacctccaagggtttcccatagcactgaaaccccaaacttaggaccctgcttacaaaggtgggtctggtggtagatgccacccacctcagccctccctaggacaccaattgcactggcctaccttctgccccagggcctttgcaccaaccaggccctaagcctgctgtgttccctgccttcttcaaggtcaagtcaggtcacagcctaaatgttaccaccttaaagatttagcatttaacctgcctttgcagtattcagggtaaacaaatatttaatgaggaaagctttcccttgataaggagtagcccagctaataagtgaagaaataatagaatgagaatatcatcattttgccagctccaaataaataggagatttgggcaatgatcatcaatggctaataacatcacaaaacaatcagtgagacatgtatctcctgatcagatacactgactaacacacatgaagcagccatggagaaaaagtaaaactgctcctaaatgagatcaagtgtctagatttaactatcagttcacagaaaacacaggggtacagaagaacatgttcaacaatgctgtggggctataatcatcaaaacatccaaatcccgactgcagggatcctacaagatacatgattcagtttcttcaaccaaaattgcaaggaaggaaaaaaaaaagttagaagaggaacatacaggtaaagagactttagagacatatcaattcatgtaatgtgaacaccatgttggcatctggatttaaacaaagcaactatcaaaaaacacatgtattaggctgggtatgacagctcacacctgtaattccagcactttgggaggccaaggtggaggatcgcttgagcccaggagtttgagaccagcctgggcaacaaagcaagaacctgcctctacaaaaatgaaaattaaaataaataaaaataatccatgtattagggaatttttaatatgaactcaatatttgatgattccatgaatttataatttttaggggtctgatattgcagtcttgttaataaaaaaagagagatacaggtcaggcatggtggctcacacctgtaatcccagtgctttgggaggtcggagtgggaggattgcttgagctcaggaattcaagaccaacttggacaacacggcaaaatctcatctctactaaaaaaaaaaaaaaaaaaaaaaaaaaatttagccaggcatgatggtgcgtgcctgtagtcccagctactcaggagactgaggcaggaggatggcttgagcctggaagatcaaggctgtaaagagctatgatcgcgctactgcactccaacttgggtgacagagacagagagagagagagacagagacagagacagacagagagagagagagagaaagaaatagggatgaaatgatataaccaagatttgtttgaaaataattgagtaaacggaagcagggagtgaggggtagtgtatagatgaaacaggactggctgtgagtgggtatctgccgaggatggatgatgggttcatggggtctgctggttcatactctacttgtggatatgtttgaaattatccaactcaggaacacagatgatgggttcatggggtctgctggttcatgctctacttgtggatatgtttgaaattatccaactcaggaacacagaaggttcatttttttaaaaaagttccttccttctgcactttgggaggccgaggtgggtggatcatgaggtcacgagatcgagaccatcctggctaacatggtgaaaccccgtctctactaaaaatacaaaaaaattagctgggcgtggtggtgggtgcctgtagtcccagctacttgggaggctgaggcaggagaatggcgtgaacccgggaggcagagcttgcagtgagccgagacagtgccacttgcagtccggcctgggcgaaagagcaagactccatctcgaaaaaaaaaaatttccttccctgactatccctctacaacaggtacctcaacaacccctagtcacccatcttatgtttgattttaattctttacctgacccttatatttttttcttttgatttactcctcataaacccttcttgatgtaagctgcacaagagctggggcctggccacccacattgaccaccatgtctctagggctttgaagatacctggcacatgggaagcttcattaaatacacattagaaaacatagaagcacatgtacaaacaagaccacatcaatcattcagtagcaactcagagcgtcgtgctctcttgtctttgtaggaagtcttgagggggcgttcatcccccttcttaggaagatgtgaaagtattcccgggccacccaaacagtttaagcattgtatcttggcaacagactgtcatgtatcgatagacacacaagtaaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagctatggcctatatcagaatccaaccaagaatgaaagccatcaatcatctacatagcaggctatttggaaacatccagatgttagagttttgaagatgatgcctagcgcaatctaatggaagtgttgttcaatttatgagccgtgatgatgccacctgaaaaatgagactgtcctgtaatcctggaggatgcaaataaagatgtgggccagtgcatttccagccaggatagcccaaatgggtgttaggtgaggccaatattcctctaccaatgaggctattttaaaaagtggattttgcattcctgcctactgtcaggatagtgacagccggctgaaccaccctaatgaattattttaaacagaagatgaaacattaacttaggaacctgagagagaggctttcactttcttaagatgaacctgtgacttgaaagagtctcaccaacaagtatttatggatgacttccatgtgcccaggcagggcacaagactgaggactcagttgagaaccaggtaaggtcagaaagggaagagaccaatgggaaaagggcttgtggctgagatccctccaaggtgccatccactagcccagcagaaccctcaatatacacacaagcccgttcagccccgagttgggctctgagtgccatggatctgtcttcaccttcatggcggccctgtgctgggccatatcaggcatttgggctgtgacagcccttgttaacagtagtgcttggctcgctctctggtgagctcccagaatgaacttggatcttgtccccacccaatgtgccaacccaagggcacactgacaaggagtatgctgtcataggctatagggacaggtataggcaacagaaagagaaggcgagtttttgctactgagatggagggtacctccactacctgtgactggccaaagaggaaggctgtgggttggaggtggtcagggtcacctccaaactcatcacaaatgagggcttccaccatcaggactggctcttcccaattctgctgctgaccaaggcttctgtatccacagagaagccctctgtggggctgtgtgccctgcaggctgaggtcatggttacgccactcatgctcctttgaggcatgaactctggagtagggctccccttgccctacacaatggaggaaacgccatgctgaagattccacatgccaccgggacagccctaagtgggaaagggagacccggggcttctctgagctcaacatactcctcccacacaaaggaagcgggtgtactgaggctgcagcccagaaagataatgtgatgcggtcgtgagatgcccaaattggaaggaggaaaaaaaggaacaaagaaatcactgtggacagatgaaatgaaaatctggcagggctctgtcctaacaaatgatcctaaaatgaaataacactaacttttctcctttggcagatacacagagagggagagtgagagcagtagccagagagggagggtcagaaagaaggttgcacccactatgtgccaggctccacactaagtataatgacactttatgtacattccctcacttaactgtcaaacaaagattaatgaggtagaccccctgagggtgcatttgcgtccccttttataggtaaaagaattgaggctcaagaagggtgcaattgggagcccctgaaacaaacatgtagacatttttttgtgcatgtgcattcatgagcattcttctggggtgagggatcatttctttcattagattacctgaaaaggtaagaaatcctcaggttatataacttgaccaaggtcactaagctcagaaaagctgggatctaaactcctatgtgacttataaaagcttctgcaaccagatctgatctgaaagcccccagtcttcactgagtaagaaagaaaaagaaatacaagagttgaggagatggaaaaggaaatgagatgggtgctgggtctaagtagaatgtccaaggacatttacaagcccctttcactatcccagaggttcttcaaagccatggcacctctttgaacatcttcagtgtacagaagtgacatgaaccaaccccacaacaaccccacccattcaccatccacacaggcacaaacccaccgacctgcagttccaccttaactgaagccagagaatgacctggaaacaatgggataagcaggaaatatccagattccctaaattatcatctctctggaagttctgcaaaatatgaacagtcattatcttgcctgtattgcttttcttaatttggagagggaactgtgtagaaagtaattaagagtgcacctcattggcatgaatgtttcccaccatgggctgaacagaagatgatgtggtgggtccagtgtcaagtctcactaagccagcatgagactgtccaggcggcatcctcaaccccacaggaagctgaggaagctgtcatctgtgactctgctgggaagaagctcagcattaattctactccaccaggtgtcaataatgtcagtgtggcatattatgtgattactctgagtggttacacaaaatttagaagaaaaaactgcactaacagcatcactcgcagagcagaactctggaaacgtgcactttacgcaatggagaagtgcactctgtctaatcctgagcaggaagatgagaacgattttataagtgtgtccccttctatctggaagattgcaagacacatggaacgcctttcagaagacaaaacataccaaaacataccaaaatctaagactgtaagaagcaacatcgtaatcccatgctaacgttaataccctcatggagtacgactacccatgagcaaactcttcttccatttattgttgacaccagtttaaacatgtaatccacatttattttgattggatcatctatttttgctcttgcagtcatttcctgtcaagtttctagccaaggtgaaaagtagcgaacccccagagtagactctttgacaggggaaaaaaaaaaaaagaagaagaagaagggatgctgtctgtgcccaggcactattttcttaaggtggcagctttcctcttctaatgatgcctctggtcactgcaccaaccagttgagtcggtttttctggaaagttctcaccaatcactgaaaagggtgtttgtggaggccaaaaatggtgacaatatcaagagccgcacagagtctgccaaggaacccacggggctccgacaagatggcgcccaaggaagcatggaactaactgagccactgacgaatgggatagattctggacaaaagtaatgtaagacatgatccctgccccaagatgtttccaattttagggatgaatagtaagcaaatactaagtaatcagccaaacgaggctgtccaatctttttggaataacatgagatacataagtaatacataaatgtaattgggtgcaagggtcagtggtacagattcactgctatattcatttacaaaagtggggaatgagggaggtatgtgtggttttgatgataacatcattttcaccctcccttcttacccattcctgcccttcatcttattctctcccacttggagaatcagcgcctatccaaggcccaagctcacatcctcagatcatccttacctgctctcttccccatttctcccaggtggaaccacctaaaaacagcattaagtgtctcactctaacctagaccctctggcatcctgcaccttacataagctttccctcacattcttccatcttccactggggagccagtcttaccctctaaaacaaggagagatcaggtgactttgccaggtcccccagatctcagggctccgcactccctagaggggaaagtccttgcttctccccctccacccgttcgcgctctatctttggctacaactacatcccatgacctttatacactggcagatcttcagttttcagggtccacatcgacaggcttcttaggaatcttctcctgttagacagtgagattcctcaggcacagagagcctcctggtcaccttctgcacctccaccttgattgcttctccaggctcaaggctcagtagccctctgttcacctcaggagttgtaagaaacaaccctattgtacatacagccttggagatgaaagcaggaataattacctccagaaaggaagagtgggtcttggcaggaattctaagaatggacaggagaaaaagctgacgatgatttgacatgaaaggaagaaaaatcagaaggctgtatttccaaaatccaaataacagagaaagggtgaaaggtgaagatgagactatgctttctgagccatcccagggcaaacatctgctttctcattcatttccttcagataagggagagaagacggaaaggaaggcaggaaggacttcaaatttttaacagttttagtagagaaaatggaaaattaatcaaatgctattaccaggccttacatttaaaaaatactggggagactagaaacacgaaacagcaagcctggccctggagccttcactttcccttctgtgagctcttgcacagttaccagcccctctgccatcatccttcaaggaccagccagccagagccctcgccaaccagaggctcagttatagcagaacacactgatgagagctaaaggtgttttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttctaaagttctggcctgctgaatttcctgatcatctagaaaaccgggaaggggagtataggctaaaaataaaccttaatgaccaccactttcatttgccaaatatttctccctattgatttttattagccattttttcaaaacaatctcatttaaacagttcaattccttattaaatcatctccaagcatatcctcactagattctcattaattacaaagggaaaaatagtaacttcagaatggataaccccagaaggaaccaccataactaactgaccaaagctgatgcccgcaatcaagagacaaatcaatatcatgtatctcatgaaacaatacacgagaaagaacacgctttcttttttggcatttctaccaaaatacacagcctgattctaatcataaggaagcatcacatgaacccagttgaaggatacttgacaaaacagctgacctacactcttcaaatatgtcaaggtcataaaagggcaagacagaggaacaatgctagattaaagaatatgggccaggtgagatgtaatcccagcactttgggaggccaaagcgggcagattgcttgagcccaggagttcaaggccagcctgggcaatgtggtgagacatcatctctacaaaaaatacaaaaactagccagatgtggtgatgcatgcctgtagtcccaggtactcaggaggctgaggtgggaggatcacttgagcccaggaggtggaggttgcagtgagccaagatctcgccattgcactccagcctgggtgacagagctacagagctagaccctgtctttaaaaaaaaagaaaaaagaaaaaaaaacggctgggcacggtggctcacgcctgtaatcccagcactttgggaggcagaggcagacagatcacggggtcaggagatcgagaccatcctggctaacacagtaaaaccctgcctctactaaaaatacaaaaaattagccgggagtggtggcagtggtggcaggcgcccttagtcccagctacttgggaggctgaggcaggagaatggcatgaacccaggaggcggagcttgcagtgagccgagatcgcaccactgcactccagcctgggcgacagagcaagactctgtctcaaaaaaaaaaaaaaaaaaagaaagaacatgaaagaggacagctaaatataccttgtgatctaagatattcttttcatacaaaggatattattaggaaaatttgaataaggactataataacctaatagttttatagcaatgttagttctctgattttgatcattgttctgtggttatgtaaaatatctttgttcttaggaaatacacactaacttattttgatgtcaaggggcaccatgtgtgaaatttactctgaaatccttcccaaaaaaatggcaatgtgtatatttctatttattctccgtctttatggagagagtaagattatgaatgcgagagagaagtcaaaaaaggaaatgtggtaaaatgctaatatttggggaatgcaggtgagagaattttcttactatgtaaagtacattacttttctataagtctgaaattatatcaacattttatttatttatttatttttgagatggagttttgctcttgacgcccaggttggagtgcaatggcgcaatcttggctcactgcaacctctgcctgccaggttcaagcgattctcctgcctctgcctcccaagtagctaggatcacaggtgcctgccaccatgcccggctaattttttttttttttttttgagacggagtctcactctgttgccaggctggagtgcaatggtgcaatcttggctcactgcaacctctgactcactggttcaagcaattttcctgcctcagcctcccaagtagctgggattacaagcacgcgccaccacgcccagctaattttcatatttttagtagagacggggtttcaccacgttggccagaatggtcttgatctcctgaccttatgatccgcctgcctcagcctcccaaagtgctggaattacaggtgtgagccaccacacctggcctttttaaaaatatttttagtagagacggggtttcaccatgttggccagggtggttttgaactcctgacctcatgtgatccgcccgcctcagcctcccaaagtgctaggattacaggtgtgaaccaccaagcctggccaaaattttaaaaattttttaaggaattggctgggcgcggtggctcacgcctgtaatcccaacactttgggaggctgaggcaggcagatcacgaggtcacgagatgaagaccacactggctaacacagtgaaaccgtgtctctactaaaaatacagaaaattagccaggcgtgctggtgggcgcctgtagtcccagctactggggaggctgaggcaggagaatggcatgaacccgggagtcggagcttgcagttagccgagatcctgccaccgcacttgcactccagcctgggcaacagagtgagactctgtctccaaaaacaaaaaacaaaaaaaaaatttcaaggaattacaaattgaaattaaaataagattcctaacatccccagtccaattatataattttgtattcttaagtattgcaattatatatattatgcatatttcagatgatatgcaaatttcatttactacttattgtttccatattgaggaaaatgttcaatgaaaacagagctcctatcagcacttgcagttcccctccaatacaaatagccccaaaatcaacatattattcccctctttaaggctttctttttactcagaattcaacatgtgaaagtactctctaggttctcaatttgtttaggagattacgagaaaaataggagttttcaggtatttgtgttttgctttttttgagacagagtctcactgtgtcatccaggctggagcacagtggggtgatcttggctcactgcaacctccgtctcccgggttcaagcaattctcatgcctcagcctccggagtacctgagactacaggcacgcgccaccatgtctggctaattttttgtatttttagtagagaaggggtttcactatgttggccaggctcgtctcaaactcctgacctcaagtgatccacccgcctcggcctcacaaagtgctcagattagaggcatgggccacgtgcctggccatgtatttgttttaaataaatctatgatattcacactcacctacacgcctttcaaaagatggtggggggtgggggatgggcaaaactagacttccgaaagatggaagaaaatgggattgcaatttttggccctgcccaagatcctctctttaggcagaatggcctgctcattggctcccgaccagagtcctgaactcccacaacagcctggggtcttcttcctctgtctctactgatttatctttccagtttcagcctgactctctccttagagcttccccaccattcagtccaggaattcctcaccctcgaaggcccagagtatttacttcctgttccactctctgctactcactacggatcatcttgaaccctgttaaccttcaatgggcgtatttttcacatccttccaaaagatcataggctgggctcatttcttctgttctttttatattccctcacagcaaccagtatttacaactaacagatgtttaataaacagctgcaaagctcaacatgccctaatgttttcaatgcaagaatgaaggggaaagaatgcctctgaatgactccaaaagcatgcttggagaaaatggcaaatgtttctgctgcacatttagaggccccagaatacaaatttgcatttgcacgacttcccttttcaatgagaattcaggtacgttctttcattttatcttattagtatgatgagatttgttcttgatgaatccgtaccacctcagctactcgtcatcattccattatcactacgtgtttatagattttcccttttattactcattttattttttccatcaagtatagttcatatacgaggtagtaattaccaggttttctgctccttacacttcaagttcgccaatttttttctgatcataaaagcctaagtgcctattgtcaaaaatcttgaaaacagagaaagtatgaagacgaaaattgtccataatcagtgctgtcttcatatagatattttaaaggaaactgtgacaattatatgtgtttttgggtcttgctacccacccctcagtctacggagcttgcttccatatccttaaatattaatcaagaacattattcttaatggctacacagatttccaccacataatcgtaacacagtttacttaatcttcttatattttaaaaggcgtatggctgatgtttctaattgccttcgtaataagcatacttccttgctaacagaacactcactttattcaaagcacaataccctcagccaaaacctgttgtctgttgtgcccgaggacagtcatatgatgcagtcccagccaatgagatgtaagataaagcaagtgggcggggctttggaggaaacttttaaacaggtggtctttcgtgacgcatgcactctcaccagcctcactttcttgtgcctggagctcagatggaggattttttgattttttttttttttttttttttttttttgagacagtctcactctgtcgctcagcctggagtgcagtggcacaatctcggctcgctgcaaactccgcctcccgggttcacgccattctcctgcctcagcctcccgagtggctgggactacaggcacccgccaccacaccaggctaattttttgtatttttagtggagacggggtttcacggtgttagtcaggatgcgatctcctgacctcgtgatctgcccgcctcggcctcccaaagtgctgagattgtaggcgtgagccaccgcgcctggcctggaggagccatctttagaccatgaggaggcaacaagcgcttggtgagaatggctacatggaaacatagaaggaaagtggatgtctgctgactcagtggaaccttcacttctgcacctgactgccctcctcccaaggctgcttatataaggaaaaatgaaacctctttttttttttgagacagggtctcgctgtgttgcccagggtagactcaaacttctgggctcccagtatcctcctgccacggcctcccaaagtgctggcattgccggcgtaagccaccacaccatgccctcctaactcattaaagccactttggagtgtttctgtgatctatagctgagtggtgtgaaacaaaagaataacctttttttcccccaccttctgctgtcttcatagcctgtgatacagcttcaaaaacaaggaccaagacctacacaccacaactgctggggtcatccagtccaacctgggacagaagtcctggacaggagaggtgtcaggtctctcttcctctgaaagggggctgcctaacctgttgatgctgtgctcccatcaagaagctcacagagaatgatatgggccagtgtttgttccgttttagtgctcatacaactctagctgagattaaccaagaaaactgccccttactggctcagggaactcccatagagaattcccatagggaactcccatagggaattccaaacttacaggccagtaaggtggcctggccgctcttccacctggaacacagctcactgaatacggcagatacctgcagactgggggcagaaactgggctctggatccctttcccagcggggagacctggcttggttgtgagcccagccctgcagggaggctgcagatccaacacagctcctcttggaagccctctgtgccaggaggcacagcccagatgccccgggaatccctgagggaaatttcataaaacatgtgactatctacacagcctgctagaggccagatcattgctcacacggctaagttgaagcctcagtgcagtttctacttcattcagggaactggagttgcagctttcactagaagagctgcttctccttgatgaacaaaccattccgcccataaaaatgctgtggaaagtactgtaaacgctaatgcagccaaaaacttaaagactggtatagggttaactgaactgccacgttaagtcaggtgtaacgagatgacaatgctttaatcctgctgcttaaagcgatgtctaaaatgtgcaagtcaaatttcaagcctttgtaagaacataatggtaaagataatttcatcattatcaggtgatgcaacaacctgcccggtcccagggctggaattccaaacagtcacgcctttgcagagttttacagccctggaagagaggggaggccacagtgaacacctgtgatgataactccagcccatgccccggtgatttttgacaattgaattaatgttgaaatgagcttatttttctgtcctaaagggaaaacgagcctaaaatcctgttaatctagcatcctggttactcagtttcaccataatttataggatagtttttctatccaaaaactaaggctatttttatcccaacttcgccgcttcataaaacacacgtgcatgcatgcaacttcagaggttttggcctaaagcaagttttcaaaataaccgggttcaaatatttcattgagatggtaggggtggaagaatcttatagaagcaaattttactgttctctgtaaattcagacttcttcagccacagatggctcagggatccagtctcgcttgagaaacatgatggaataagcccacagtcagagcttcttctcattcagtttcatgaaagctctgagctcccacaagtgtctgctggaactggacaggaagcttgcaagatgctggctacgattcagcgcagtcaccgccttccccagtcggcccaccatccccagccatccaaccacttcctccccacgaggcatcgcccgttggaaagttttattaaccaaatgcttgagggtttctgtatatttatattacctcctcttctctcctgttctacccaggcatgttgaaaaaaaaaaaagttatgatatactttaataaaaacaaaattaaaatgattaaacctttcatatcctttagagataatctctcttctcctggctggtccaatctggaagaaaacaaatgtgaaccatagcttgctgctgcttttcaatttttttcccccctaaagaaacaaacagaaaaagccgcctgtggccagatttttaaaataaattaaatttgtcctcacacacggcagccaggtgtggttgaaacattctttccagatatctatgatatatgccaacatccttccctctgggggtctttcaacgtgagcctgacaatcccaaggggaacagagacttggcgggggagaaaggggggtgattccaaaatagttattgaaaaagaatcactatttcccaattagccctgtaataatgccttacaggaatgactggatgccctgcccctgcacgccatctaccaaaaccaaaaaatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttggtgttgttgttacaatatctaatagtgagatcaaattcttattgtggaaataaacatcacggtcttctgtatgaagatggtctgcggaaagtgaccacgcatcagagtgtccagcgtaggaggagaatctcagtttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgtactcaaggttgctggagacatggcgcctctatttcctgcccaaagaagcccccttaactgggggccacgggttgagtggtgaaggaggcaactcacacctgaattatagtgggcttgtaaacctgaacagggcaagtcacaactttgggaggctgaggcaggaggatcacttgaggccaggagttcaagaacagccctgacaacatagtgagaccctgtctacaaatgaaaaaactagccaggtgtggtggtgcatgcctgtgctacttggaagactgaggcaggaggatcacttgagcccaggagatggaggctacagtgagccatgattgtgccactgcactccagcctgtgtaaagaccctgtctctacaaaaaaagaaaacaaaaacaaaaacaaaaaaacaaaaaaaactcacctaccaaaagtccagctgacatctactacaaaattcccattattgccataaaaacatgtgggctgggttcaaggctgcatagcagatggccaggctacatcctcatcacacacgcacttcactggtgccagtgccggtgacaggctagaagccactccagtgaggacccctgccagggccaatcagatcagggctgccctccccatgctgtggggcttctcaatgcttctgaaatggactcacacaaggaagtcacaaagggctttggacattaggaaaaccatgcaaactgtttccacttctcagagcaacccgaggcacgcgctctggagtgtgcagagtcacagataactgctgctgctttgctcaccgcagtcttaggatttcttcatttctatcctggagagaatccagcaatggatcacactgttatctagacacaaagaatcccacccctggggcaaagtgctacttgtcccgtggatgagtttgtcagcctgcagcaaggaggccagacgcagtgggaagagcacagccctgggccctgggcctctgtaccaagtccctactctgctgctgtctacagcagccctgtcctcaggaaccttctccagggaaggaaatggcttctgtctgcacatccaatacagcagccactagccacatggcactgagacagatgggccgctgcaatgggaacctagcgacatgagacatccaagattgccaggaagggtccgagttcgcctctgctttatgctcgtgcaggacaggaacggccctgtggaggctgccctcgaggctcacatcacaggctcaatctgggaaagaccagccatgggaagcaggatgtgacttgccctggaagcgcaagtgaaggacgggctccgaatgaaagctacacaaggtaacaatatacacactgggatctttatattatgtccagcctggagtatataacacagggtaaggaaaaaccaaggaattaaaagtccttcaggtacttcgagcaactgaaatcctttggatggaagtccagtcaatcagctggccccctattgaattctataccctaatgggtcatagaaaattgtaaggctctaggtagcatctaccccaaccagagcacaaacaccacacacaagcccagggagatctgcttagtccctaaaagcacagtgggcagcaaggaggggtttctatttcttttttttcttttgagacggagtctcgctctgtcgcccaggttgaagtgcaatggcgcggcctctgctcattgcaacctctgcctcccaggtgcaagtgattctcctgcctcagcctcccgagaagctgggatcacaggcacccgccaccatacctgcctaatttttatatttttagtagaggtggggtttcatcatgttggccaggctggtctccaatacctgagctctagtgatccgcccgcctcggcctcccaaagtgctggattacaggtgtgagccaccatgcccagctaaggagtttttatttctataaatccctccaacaggagcctaacacaggccagcctgctggagcaccttcagcaaaggcagcttttctcgatgctaagaccatcaaatttcacaggcacaagaaccttcctccacgtggccggctgtcagtcctcttggtgtttgccagcaagaaggtttcggtgagggctgtgtgagaacaggcaaggaaagagtcatggtaaaatgggctcagaggacacagggctctgaccccttttcctgtcctaacaagtgtctttgagcacttccggcttcatttggagtccccttccagcgaggtcgcagtagttaatcccatgccaaggccagcactgagaaccgtgtgctgcgagcaggaaaccagagaaggcctggtgggcgctgacagttctgtccgaggcgacttccaggatctccatgacctcccttcatctctcccaccaccttctgtcctaccctcctgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaaactgccggcacctggatcttgaacctttagcgtccagaactgtgagaaaatacacttcttttgtttcagccaaccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggcataaaactataaaaacccatttaacatccactctgaaaaacacatctttacaaagtcctttcaaagtccctcaaaactgctaatggaataagacataagtagcaaaaagcaaaattaaatgcttatttgaagactgttctcccaaactgagaaaaactgtgaaacagagagaaagatcagcaagaaaagatgtaccctatccaggctggcgggaaccacacttctctaaaatgcaagccaaaaaatattaaggaaaatgtagccccaaacctagcctgggtctaccagaagtctgaggaaacccagtgaggaggagctgagcatggtccaacagaaccttctgaactgctctagaaatctgtattgtctaagttaaccatgagccccatggcactattaagcacttgaaatctggttaatatgatgcagaaactggatttaaaattttatttagcattaacagagaattttgagaagcttccttgtggctctcaggagaccagaaagcccaggaaccagggaggtatgggcagcacttagactgaggccacaaaactttccactgctcgtcaatgtttgaaaaaaataatttggaaccataattcttataattgggtcacagtttgaagggggttccttaacatctgtgactctgagaaaaagcctttgagctatttctgtacgcagagagatagatgcatgttctatttcctccctggcccctaccaaggtcgggaacaagtttcatataggatgtaagtagccctagaaatggattctttggacattcctaaagacggtacaggtacaaatcattatttctcgagaaacatccattcaggcagtggagaaagtgtgaactccagaggctaggataggggatccatatgggaggggtctgcacacatggcaggagacagcagaggacggctgccacttcctgctacactgtcggctttaggaggtctctcccctccagtgaaatccagggacagcacccccaaatccagggacagcacccccaactcccagcccagcacaaacacccactgactggctagctatccatattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatcagcaggtacccctttttcctttttttttttttttttttgctgtgccaaaaaaaaccctctctgcagtgagtggccacagtatcaatgcttctcccagtgggcagcgttgggcacgtgctgccacccactcatgaagatagcatggaagacagcctggagcccttgaccaagaacaacactaaccagaagggcagtgtacagctggtgccacgtgtcatatgctgaaacaacacgcacaaaaccctggtagcttcatcatcccagaaaaataacgcaacgaatgaatggtggatctagaacatcaaagaatgagtgaatacgaatcactgcaactcaggccactgcggccaggtctagataactgctgaaaaggtgcaagtcctggaacagccagccaggacacaggaggctgggtacgaggctgcacgctcaacccactgcccacctgaccatcctggtgatgccacaccttctccagggggaccttccagggcagcagcgtctgacagcagtgaaacagcactgcatatgtccaccttccagcagaccagatcattagcatattttgcagagagcaagcagaaaagtttaattgcccttaattactcagttcaacaaggctcctagataatggctctcagatttcttgcctggtatcgacgtaatttccctgactctggcttcattatatccctaacttagaagcaatagcgtctccaagatggctttccagaacagacactgaagtgccagtgaggctgggcagtcgctacaaaggtttcttctatgaggagtcagatttttggccttcacaccactctggggtgtgtgtgtgtgtgtgtgtgtgtgtgtgtgtgtgtgtgtgtgtgtgtgtgtgtgtgtgtgtgtgtgtgtgtgtgtagcgggtagtggggaggacacactagcatatacttaggatggactaagacaaggaatatgtaatcagaagccatcacaattacaaatgtaaatgaacaggcaattggcactgacctttgcagattgttagaggactaattaaggcaaatcaagaactctgttccaacagaaaaacaagacagtatacaccctgagaactactcctatcctctctatgtaaatgcaaaatgcaggagaatcacagagtaatcaaactacgaatattggcaaataaaaaacatctccatgaacaaaagacaaccaagatttacttcttcgtagcctgttagtgattctgctaaaatctctatcaacaagcaccaccaccattctgagcccttgccacacatctgacattctgttagagtccatataaatacatcccaccgccaaaacagccagagacaccagtcactaactccttgcttgaatattttaaaagctgtaagaaaaatacttacaaaaaggaatcaacctatgttatcctgtaaactccatttttcatttaacaacattatgttctcttttcatgttcatacataatgacctctctttacccttgcattgtaaagcatctttctaaaaagcttgctgaaatttacaatccctgtccaaacagtccttcatcagggaatgtcctttagacagataaagtcatgttttccccatgcctccatcaatgcttaaaatttcagtcacccccatttgttttgatgcacttttacatttaacttctctagttaaaaatactttaagttcctataccttccccaaacccggtaaacaagacatacagtaaaaaggaaaggagaaagagcgtgggtgtgctgattttataaaaacaatatttcagaaattcagagctggccacaacatattttagtgctatcagaaaaattacactgaaattgcatataatttagctatttacaaaaaaaaaaaaagatgtactttatatttagagggcagccttacaccaactttgcaaaataaaaacaaaatcaagtgagaaagctgaagacagtatatattcttggtctcttaactcttaagctgtatacattaagcacaacaccctgaaacttggtttaaaaagtgattcatcaaatgaggccagtgagtgttgcagtaaaggctgtcaccaaaaccacattatcacttggcaagctgtgtgcacctctctggccccagaaattcgctactatgaatgccaaagacgtatctgtaaagggaggatactgctttttgctccaagcaaaacaagtctcttaaattctgaatgatcgtgcaccctctgtaaactgagtccgggtccaattatttccaatgcctgagctggtctagtcatcagtgtgtccatattgagagtgcagaggagatcagtgatcagctatgttctccaactcataaaaagccttatatataataggtcgtcaataaagaattgttgaactttaattacatgcatgtaaaatttggaggtctatgtctacatgaaagaaaaagtacttaggacaaggcgagtaagagagaaaacaggaggaggagaaggagaaaggccgacagcagaaacacaaagggcctgtgttctcaaagcccagggcacttgatagaatgaagttaactacagtttcacccaggagccagaaatgccttttaaataagcaaacagggaagctgatcctacacatgacccacctctgagagctctccatttttcaagagcttctggtaaaccagggaagcaaatggcagatgccagcaactcagagctctggcccagtgcattggccagtgatgacgagtggtttctacctgtgggtgggtaagtatgaaatgccgagacgaaatcccaaccaattccagagactacttggtcttgcagaaaaaacactcaagccaataaaaataaattgtggggattggaagaggaacctcacctggttagttactgtctttgagagatgtatttccaagccatttttaaaacaggaaggcccagcaggcttgtgtgcttgtgtctattgtggggtaggggtggaaaagtgtaacgacaaagaccatcacactgaaccaaagacaatttaccacaggactcggcctgcccactgacataagggcagagctccgccatggcagggccacatgggcacagaagcctaactattagcacacagctggcggccaaggctctgtccactggtgcagggcaggacttagatgtacgtgcccaaccacgaggcctctcaaggagttacgtagccagtcatggcagatatagatcctggctgctaccagaagattctgaagggatggaggagacctttgcaatttcttctacctcgactccttcctccagacccacaggttcacatgggttggcaggctacatgatgaactggaccgactggcaaacaagtgacttaagtaacaggtaaactgggaataggtattttttgtcatccacagggcagaaactattgcagaatcatccacagggcagaaactattgcagagttcacccctcctgccttaggaggagacatctagatacctgtaggaggtgacatgagactggggatgaggtccagaactcagaaaggacaaggggttatttctgaagggttttgtgtaatattctgtggcatgtggacaacagaggagaagaggaaaggagaaggaatgtcatcacttagcaggatgatgacagaaagccagaacttccaactctagacagcacagccatggatggggagcttctggtcagagtgggtggggctcctaaaaggtgcaccaagacttcctaatgctcctgatgccacaggatgacatttctagctgaaaaatcatgtcctgacccttatgttaaagaggacagagttgggaatagtctataaagtcgatgtttacaaaatttgaagttgatcatcttaaacatctcaattctaccaggtccataatgtccgttctcttgaagatatcctttcaagttttgaagagccaacccctggggagagggaagatacatcttaagatgagttttcttaaagtggttcctaaaacggaaccaagttcttgttaatgtcaatatgaataaataatacgtaatactttgtcccttttgtcatcagttatatggaccgaactggagcctgtgtgtgggaggggaggagtatggtgtagggagggagtaggggagagagcaaaaacatgactccaggtcaaagccaatcccaaagcatcttgacatacggaagggaagtctatcatctccactgaagttgctcacacacttctcgggggaaaaacccctagtatgcactaaatgagaggaacctcgaaggcactggtgccgggctgcatccacggaagcactacattccaaaacagggaactgtttgttccaggtcaccgactctgggtgaaatggcagctgtacactgtttagtgtggggcacctcattaatacaaaaggaattctgagcagagtaaaagaaagaattgaagggtgaaatggaccagcttttaacagatgattaaaacaatgatgtatgcagagctggccaaaaaaacaccccaaacaaagcacaaaccctgagcaagaaacaggtctaggtgtgttggtagaaagaaggagaatccggggaatgactcaacagtgcactaatgcagagcagcggatcaaacagaggccacaatccctgggtggggcacaggctcccctacagccagatggcccaggggcctcagcctcaggcccatcctcgtcccttactcctgagagtgctcccatgtagacggatgggatcagaggcaaagcagaagctccaccaattaaggtgtttcaactttaaccagaagaggcatttgaaaaacacatggaagggacagtcttgcagtgaccttcaagtgacaaaaattatcccggtacccaacagccctttcctgaacaaacaatttctactgactgtcgaaacctcaaccactctagcaaggagaaaaattcttgaattgtggtctatcccatcatttgggaattgctgtttcatttatatgaggaggcagcgaaggagcagtcagatgatccagagaggagcaggtgggcagagggctttggaggggcttaggagggacgcctccaggaggaaatgaagctgacagaaaaactgatagagcagagcgttcagagattaggaaatgtctacttctggcagagtaaggttcgccatgaattaatcataggtacctagaaaaccagagaaaacaataagttgtacaagaaggtaaatgaaattataaaactctacatggctcagctgcgattaatatttatagttataataatgaaaacactgaatattaatataacccccaattattatttaatcataatggaaggtggagggaggaaggactgagtgtggagggagctggggagtgggagggagtccaactgttgtgtggggggtgcaggagtgtgcggggcagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagcgtggatggaatgtgtaggatgcagagaaagtgtatgtgtgtgcgcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccctggaaaagggggtgggagagggccatgctcttctccataaagtttatgtaactttttgcctttaaaaaatataaaaatgtgtaatttgattatattaaggttaaaactgcacacatccatgatggctgaatggctgagaaggcactgcaggagactgtaggatcaggagtggccttgggtctctggcttggccaggccgttagacaagctgccattaagaagaaaaagaagtgtggcagagaaagtggtgagccaggtgcccaagaggtgggaccaatgagatgtccacgaagctcagcatctgggaggtgggaccagtggtgtccaggaagctgtacaaaggcatttggcagcaccaggacacaaaagctcaagaggctgggagccgaggaccaggccacagtgccctgtgcccagggacatggggcaggctgagaaccaccagccagagtcaggcttgcagaactatcaagggaagtcagaggacaagagaaaaacaccccggaagccaagggaaggcaagggaaggggaagggagcttcaagaaagggctgggcaacaatttcaaacattgcagaaagaaaacagtcaggcccagcaggtcctgggctgtgtcaatcaaagatcagcagcgccctcccaagagtggcttggtgacagaggaaatgggttgtaggaggttgagacatggaatagaggtgagcagttcacagggttctctcaagaatctggaagattctgttgtagagacagtgtggggcctaggatgaaaggagagcttttcttggaaagttttggtttctaaagaggtaagtgactgtcttgtgtgtctaagtggagagcaagagactggaaaattgaaaaaatagaaaagaggaggtgattctacccaatgaagtccctatggaaggcggagtcatgggtggagggagggagggaggtggggaaaaaggtggctgcagggagatgacatggggaggtagaaacgaggcaagctcccactagcaggtctcgacgcattgaagcagcaagcagcatggacccaagaaacacccagaatcactcccaaatacaactgaaatttttataacaagcacttattttattcctctctaaagttcagttttacagaccagactttgaggccacaaattgactactcttaatactgggcaggacacacgatgtagcatctgctttgtcaatttgaaccaataaattgaatctaaagtatgtactggaggaatcttagaatagaggagagtatcttctgttggcctgctccctgggtagtagcttgtgacttccctaagactgagccttgctccaagaaaagtgctgccaatttcctttaaaaaaaaaaaaaaaaaagaagaagaagaagaaagaaaagaaaagaaaaaaagacagaaaggcgggcaggcaacaatccctgcatgttccttccaaaacacaatgctcacctgtgaagtcagtaaggaacatgaggaccagctggatcagtaacgtctccctcaaacagaagtcctctggaggtctcaaggaggtgaacacccaggcccaacctgggcctcccatgcctgtgagaccactcacctgggtccgtggaggggcacctgcggatggtgaagatctgccccaggtcctcgtcctcctctggaaggcccttctgcagccgctgcagctttcgcaggctctcgcttcgctggtgcttcatggagcgcacatgctggatgaggttgagcttggccttggtggagtagttgcacagaacgcagtggtagtagcagctctcaccttctacaccactctcatgctgctgcaggtgctgcaagtaacaaaagagaaagacatgccttgggtaagccactcgaagcggccactggcatcagcccacaccatcctggtcacagccagaggcatgcctccaggggacacatctccacagccaaacaggacagtctttgatatggtttggctgtgtccccgcccaaaatctcatcttgaattctaatctgaactgtaatccccacgtgttggggataggaccttgtgggaggtgattagaatatgggggtggttcccccatgctgttcttgtgatactgagttctcatgagatctgatagttttataaggggcttttccctacttcactcagcacttctccttcctgctgccatgtgaagaaagacatgcctgcttccctttctgccattattgtaagtttcctgaggcctccccacccctgcagaactgtgagtcaatttctttcctttgtaaattacccagtcctaggcagttcttagtagcagcacggtaatggactaatgaggtcttcaactgtgagattccttagagggtttttttttttttttcccccagagtacccagcacccttctctagcagttctttgaaaaaacacagcaagctgatacccattcctatctcccccaaatggccccagccatgtggcttttcagaatgttgataatcctgatcacatgggccctcccagtgcaacaccggctttcctggcacaaggttaaaggtttccccttttattctctaaagtgtcctgctcttgttagatcaggggttggcaaactatggcccacgggccaaattcaacccactgcctgtttttgtaaataaagttttattggaacacagccacgtccattgatttacatactgtctatggatgtttttgaaacatcagagttgaacagttatgacagagatggtatagtccacaaagtctagattattactatagaaatgtgctaaattatgacaggaaaagttaagccaacccctgcttcaggtaatagcctctggtcatcctgcctgtatggcaccctaggtcaggaacatggagccggagctggtatctggctttttcacaagacaactccagtgtttgtatttaaaaccacagtctactgggagaaccccaaattaggttttcacctagattaaaaaatgccagaaaaataaatttctccagactagttccctgtcaatatctcaaagtcccctggcttatcattggccaatatcattggtcagttggtgtatcagatggtcagatggtccaaattacgtcctctgttgtacttagtagacacagtattgatcccagagcatggcagcctaagagcctccaggaggcaggcacagacaggattcatgtctggggtatcagaacagaagaggtcatgatgcagacaggtggcagaccccaggcttctgtggctaggaagacttaaagacgacccaacaacaaaactcacaatgtttctgagtctcctgggaatgtaatgatagctatggaccctttttgactaacagagaatgaatgtgcacctggtgtagaaaggccatctccttcattccaatgattcactttaggggaagagggaattcttccactgggtacacatgaagcaagggaaacactccccaaaagcttaaatgactgacccaaggtaacccagttagttagggggagagagagatgtagaagctgaggcttgtctcctccagccatgtacccagcatccttttgaaggaggaaattcaggtcatgtgagtgctttatgtgctcctgtgattacgtgtccttccttttttctcctcaccacctgtccccaacccccagcccagtcagccaagcctggcccatggagccatggcaggcacacaacaaacgtctcagaactgcccacgttgcttgtctcctttctgacccacactgcttctgtctgatgtttatgccaggataatggtttctagtcctgcttggatgtctcatccttgtccagcttagaatgcaagacactgacaagctagaatggttagaatgccctgcactccacgcaatcctgaaaataccagagtggccctgtgagtgcttcctatcaagggacactgccctgacgctcacgtactgacatgcacacgtcctgtgttcactgatcacgtgtgaaaaatccagaagcatgtttgtactttgctggaagaagaaacataaatgcaccaactaagtgtcacagaaaactcatgggaggggggttgaagccctcaatgacataaactggctaaagtatcccacaggaaatcttgccaacttgtacgtaagaatgggatgagcttcacaggcaccaagaaagaacaatcccttctgcccccaaaatgggtgattcacacactcatatgcagcaccttggacaaagcaaaatttctacaaccagaaagtattggaagaaccagtgagtgcaatgttacctattagaaaaattacaactggtgataaaaagctacttttctggagataaatttgagctgctttttgtttactttttatttattggtttttttttttttttgagacagggtctcactctgttgcccatgctggagtgcaaaggcttaatcttggctcattgcaacctctgcctcctggattcaagcaattctcctgcctcagcctcttgagtagctgggactacaggcataagccaccacacctagctaatttttgtatttttagtagagacagggtttcaccatgttggccaggctggtctcgaactcctgacttcaagcgatccacccgcctcagtctcctaaagtagctgggattataggcgtgagccaccgcacctgacctctgagctgcttttaaaaaatgatttaacctcactgccttctctgtgatgaggttcctttcagaggatgttgggaggatgggatgcactgaggcagtgctttctggaggttacaatcctggggagaaggaaggcagaagtgaagggagaagatgagctagcccacgtcccttcccccaactactccccgaggcccctcagaactcagaagccagaaacaggaccaggatattccaggcagcaagagtttgtcctaaaaccgaggagctggaaacctgtaagggagccaagaactgctgtcttaggtcaccaggaccaaaagaatgatattcattaaagcttcaactaaaactgagtgaataaaagatggcagagacaataaccatgaaattcaaagaaatacgttccatcaagagattttggaggtagaataaactatgaaatcagaccaagaatcactaaagccttacctccaatccccccactacctccctatgaaacaggatttcctcacaataaggcactgaatttcaaacatcaaatttgaatatggatgtgtgagagttctattccaaatggctggagtcttcaatctctgagccacaagagaggaataacatggccagaagagttggatggaaatgcgatgtcaaatgtccaaatccatgggctcttgggtcataggaccgtataaaccctggattgaaataaacatcataccgggtactcacactttaaaaaatggatatgataaaagatattctaaaatccactccacactctagctcatgttggtaaactacaatctcttacactgccatgaattattctgtctgccactttgagagccattttagcaagaaactgggcatgcattacaaatagtggagaaaagaataagaggaaacaagaaaatgaagccacggctgctcccacctaacctggtccagtgaacacctagggttctctcctagaaaattcatgaaagattcattcaaaattccaagcttgctttgtattccaagtttattctccaaaacacttaaaaaaatccagaataggccggatgcagtggctcacacctgtaaacccaggactttgggaggctgaggtgggcacatcacctgaggtcaggagttcaaaaccagcctggccaacatgatgaaaccccgtctctataaaaatacaaaaattagccaggcataatggtgggtgcctgtagtcccagctacttgggaggctgaggcaggaaaatcgcttgaacctgggaggcagaggttgcagtgagccacaatagtgccactgcactccagcctgggcgacagagcaaaactctgtctcaaaaaaaaaaaaaaaaaatccagaataaactatatcttggttgccaggaaacagctgtgcataaacctaacatcccaacccaaacttctgcttgggtctactatgtctacctgcatgtgacaagtcctgctctccccagattttccaagtgtctcgttatttcttaagttgtccaactggaagtaaacagagacccaaagctagcagcaaggtcctgacctctgtgaccttctccacatcattcggccatttcctaggccctgagcggctcaacccgcgaccctgttggtcagatcctctctcccttcctcccaagtggcactggcctcatccccagaatcccacccttggaacctgcctaataaaaagcagtggtagggagtgtgctaagaggcccatgagcactccacggggccagtcagtcagccaagaacatgccttccccgcagaagggagtggatgttttcatttggaggaggagggagaataatttgttcctgacccagctaattagaataccctcaattgggatcacaatgtatttaattaaattcactgtaatatatgaagaatccaccaaggcacaaatcccagtggtgcactcaagaaaggagctgcctgctttcagagttcttgctctcctcgccaggcaggaaatttttctcccacgcaaatcctgaattccccaaccccttccgcctctatcacagagtcacccgctggggaggagggcaaccgggttctgtttttactttttccattttctttactctgtgctcacaattcctacctactctcctttgttgggtcaggagtgtaattttaaaaagaaaacaaaacaacagctccaactgtgggcagtgtgctgggatgcatgccaaccggggacccaaagaaaaccagctggtgagcccatttggcgggggtttgtttcggtttgagtctaagtgtctacaacacgagacactgcatgcacgcgcacacacatgtgagcacacacatgcacacacactatgcccaaccccagggacttaacctgcaggtgatgcaggcagtgtcagcagcaactctaagaaaataaggaagggtataatgagggcattccccctttggcttgaatactgttttgagaatatacttcccggaatactataaaacacaggggcctcctagctaactcaagaaaatccagtatctccccacaaattactaatgagaaagcgagaccaaccagtatcttgaggtcatcctagctaaccaaaaaagagtgagaactcaggtctacccaaactcacttggttgggccaacctctccctataaccttaaatctgactatacttttccttgatcactcccactccaactcacttgcttgtttagaaagcacctggaggccaggcgtggtggctcacgcctgtaatcccaacactgggaggccaaggaaggaggatcacttgagcttaggagttcaagagcagcctgggcaacatggtgagaccccgtctctataaaaagaaataaaaaattagccaagtgtggtggcacatgcctgtagtcttaactacttgggaggctgaggcaggaggatcacttgatcccaggaggtggaggctgaagggaggtatgatcacaccagcgtactccaccctggctcacagagtgagaccctgtctcagtaaatagattagacagactacatagataaacagataggtagattagactagatagatagatagatagacggatagataggtaaaaacagacagatagcacctgcaaaagactggatcataagaactgcaaaggtactgtagctttcacagaaagaaacatctatgcttggcaattgaatttactttctgaaatcttggagaagtatgatgaaggaaggaagtatctagtttgagtcataaatgggagcagaaaaagaacccaacgatctccaagtcctccaaatgctgtgcagcggataacagactgtcctcatctggattaactggaaatttggcacacgttcgggggtcaacagctacggctggaaacgaagccagggttcatacgagggctcactcacgtcagtcaaagagaccttttcttgcacctcttcctaatcctattagggctactcatgttttaaaatgttcatcccgtctcagtttcgctggaagggggacactccaatgcttctgacacgaaaacatctcacggcccccatctgtctctgtgccttcccttctaggtctggctcactgagaagaacacagcaaagccctccctgcaaccagaggcacctcggataaaggggctggcgcgtaacaccaagcacaaaaagcaaactaatcattttaaaagaagggagacaacagaggctccgctgtgcgactttgtgggattctaccccattagtatgttgtgcttgttcagcctcgtcaaacactgaaagtcaaagagacgaaaagagggctcttgttagaaaataatgcatcgtgaaaatcaaaaaaacgtgttcctgttacttgtttcccagggaaaactaaccaacttctgtcagagaacattgatttctataaatctggaggggccccagctccctcctcctccccaacgataggaaacttctaacatctggttcctcatgcatggaatgcaaaatattgatcaggttttgtcaaagcctgccctttaaagtagaaacagacaaagtacattctgacacacacacacaaacatgcacaattcacaaacaaagcttcctcaggagtaccacctgttactacagacacacccgtggccgccctctcggcacactgtgctgtgcacacaggcacacacggcaactccatttccagagcagcccctctgagccagggggctattccaggagatgcgaggtgcttcctgcccagcagaggagaaaccccatggtggaatgtcccagaaaacccctgagacacctgtcaggccaaaggcaggcaggagagcctgtctgtaactcttctcagtccattgaactggaggccccatgatggaagaagctgcccgttacagcacccctgtccagggaaagacagcaaccacagcacgcaacagcttcagcttctcgcttcagggagaggactatgtaatctcactaacaaacctggtgagagggatggggagaagatggggaccagtaagtctgctaattcctcaacttgataagatgaagtaggaagacatagcgggtgttcattcaccatcatatgcatgcagagcatttactgtgggtgcggcatctacacacatactttttttcttttttgtctgagaaagggtctcactctatcatccaggatggagtgcagtggtgcgatcatggcttactacagcctcaacctccccaggctgaggtgatcctcccacctcagcttcctgagtagctgggactataggtgcgtgccatcatgcctggctaatttttaaattttttgtagagacagagtctgaccaatttgcccaggctggtctcaaactcctgggctcaaagaatcctcccacttcagcctcccaaagtgctaggattatagatgtaagtcaccgcacccagcctacacacacttttaaattttcacattacaaccccatgaggtgggtcacatttggttttcatccttggaggagcccaaagctcaaagaagccacatgactcctgcaaggtcacacagagcatggaggaaacaggaccagagcctgagacttgagtccaagtaccaagtccacagccgccaagctacgctgcacagactgcagggggttctggaacatgagactctgcagacccaggtgttcaccttgaatgcctaaaattaaaaagaaaatccttccaggggtaacgcaaccaggagtgggggaggttaattttttaatcagtcagatcgcgttatagttccaaatgtaatgtcacatttttaggaagactcctggaaggtcaacctaaatatatatgtatattctgttcaatgctggctttttatctgctcaagctctcgtccttgacgcatgctaatttagttctatttcattgtaggatccctgcagacaccataagatagaagccccaaccatgatttataagaaaaaagtaaaaggaagtaaaaatgttcccttagatcaatccatttgggttgctctgacctagtttctggtttctaggccaggctccttaggccgtggaacaagccatgattgctcactctccgtatccaaggccagagcggagacttcccgttcctctatcttttcccttgcacgaatcacatttcctgattcaaaattctcaacattagtggccttgagaaaaacagttaagttctagaaggaaaataactaagtctatagctgtctataggttgtacctgccttggctttgactctttcctggaaaaacacaaacatggatccttgtggaatgtcgacgcctccatgtaaacagatttcacttccctctgctaggagaactccacaaaggagtgtggagccactgtttatacatggggaggaaatttatcaggcatgcatttttaccattatgggagcaaattattaaccctgtctcaaaaaaaaaaaaaaaaaagtgtgtgtaggtgcttcgcccatagtaaatgctatgcatgcatatgatggtgaatgaacaccccctacatcttccttatttcatggtaggaccctgaggaaggggcctaccagatcataatgtcacaagcaaaatgaggactggtttccacaatggctgagtgagtgtgcacagagctcagaagctgaggggggtatgtaggtggataaaacaacaaagtgggtcccaccaagctaacctcaaactactctccagaaacaacctagagcttccagaatctgacaatcacctcttcactaggatatcatatcaggaacagcaactttcttcatttgtaagatgtacttcttccctagcactattttccagctttcccaaatttaggtccccatacaaaaataaaagcctcctgatatagtttggctgtgtccccacgcaaatctcatcttgaagtgtagtccccataatccccatgtatcatggtagggatctggtgggaggtaactgaatcatgggtgcagttacccctgctgctgttcttgtgacagcgagttctcatgagatctgatggttttataaagggcttccccactccttcactctgcacttctcttcctgctgccatgtgaaaaaggacatgtttgctcccctttccatcatgattgtaagttttctgaggcctccccagccatgctgaatggtgagtcaattaaacctctttcctttaaaaatcacccagtctcgggtatgtctttattaatagcgtgagaacgaactaatacaccgccatatacacattactctagcttgtgctcatccaactccacgtcaaactgttgccaataatgatggtttgtggggcactctagattaagcagcccagttgaaaaccctcactctgaatctcactagctgtgccacgtagggcaagtcacatacactgttgggtctcggtttccttgtgtgcaaaacagggacaataacagagcctcatttcactgctgggaggattcaatgggataattcatataaaatgtgtctgatacacggttagccttcataataaatgaggctattactaatgttatttttcatcagttaatcttcaggattagggatggaaacgaacatctactgaacatacctatttgttatttctctccttacaaccaaccctcactcctccccaggctccaaaaggcaatccttggttgacaataaagaaactgatatataggaattatgacatggacagaggatactgaacacacacagggctgccttcacccttacaagaagtgcaaaacttgccaaagtcaggctgttggtgtaggcagagcccagatccaaagcttaagcccatgcccttgccaaaaaaaaaaaaaaaaaaacaagaagtgtttactgggtctgtttgcccatcagggcaccaatgtaataaaatgcaaggaccacgttctttctcatgtctgccaatatcctgggtgaggagcagggaagggaggagagttcggctgaaatgcctggaagacacttccccgattctccaaatccactcaagaatttgcttatttgtatctccaatcccatgacagtcaatccagcagaaaaaaacacgtgtctactggtcaaaacgggtgtgctacttcatctataacctggagatattttacttgccctgtcttacacaaagcaattttaaaaaccgcatgagaaaacttccacatatgtgaaaatccttcggaacatgtgaagaactacccaaatatttgagacagtgatggtctttctactgtaagtccagatgttgcttcgtcgcttctgatgggcacgtacagccaggtgggcttggtgatggatgatgccactggtgttccagctcagtggttctctaacttgagcgtgcatcggaagcacctgggaggcatgctacgccctagatcgctggggccatcccaagggtttctgattcagagggtctggagtgagccccaagaatctgcatttctaacagtctcccaggtcatcatgacgccgatctgggaccacactttgagaaccgatgctctggccaggacagcaatggccacggaaaaaggacccaagtcggaatacctggagatgttctgttgcagggaggaaaatttccaagaccaaaaatctctgcacttggcttttcccaaagagtatcttaaattctagcaaactgcacttgataaatcatgcaatgcctgcacacaagaattcacctccttaatgaaaaagtcacacggaagcagctgcctgctactggcctgctccagatacttcataaaagtcagaattggctctattcatcttcctctcccctttcacacctgcactcgaaaatttcccagggctgtcgctggcagcgtggctcttgatgggaaagcatgaggcatcattttttcctcccttgctctgcagcccgctgagtgcacctgcccagatgtcttgctggaaccgagcctacagaagaatttcaaccaaatgcgagaggaaaatgctctttaaaactcctcccatgctcttcaactttctggttgttgctgcagagcatgaatttggtgctcaaacccagaggctcctcttgagttcctactatttgctgacaaatacattcatcaccttcataatgagagaagacagggcagccggcgcaacacaagcaggaggtaagcagcacccacaaggctgccttctgcctcgtacaaggggcttgattttttattttattcttctcttaaaagagagaatgagaaagtgacggggcgaggcagaaaaactccctctaaatcaacacttctggcgtcgatcactctggctgatgcagacatttcactttttctccttaaattccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggacggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccgatattgttccgcctcaagatggagagctcagcatggattttactgaacgttaaatcaaccagcaagcgcagccagcaaactctgtggcactttaactttaaataatgcaataattattgaatttcctttttataactgaagtgctggaatgtaaacaatggggctgtaattgcaggaaggggggatcaatagaggcaatcgttttcaaccatgttaattgtaaatacaattgctccaagatgtcagccttgttcttcttgctcccagaatcatcctaacggatgacagagtccaactttcccattacagctgttcgttcctttaagaggttctcaatcaggtctgatcaatctgtcaagataatgcatggagtaagtaagactcttccaaacacaggctcccaatcaatagcccggaccagcttaatgaggtggggctgaggcccagagggaggtaacagcccccagcttgcgcctgggtttggcaggctggcttcctcgcatggccctgataaacagatcagcccttaatgaggacattagttatgcatgcttcagcaagcagcaaggcacccgtccctggggacagacggacagaaaacaaaatagattaacagaaaacaacatggtaccaaattaggtctcactgaagacttttccctccttttcctgctttccttaattgtccagcagagtggaggacaccaattaatcattccaatgggcctgagcgcaaagacctatgggcatcccctggggtagaggatctcaagctgtccctgaatatgagcaccctcatttttgagacaccgttttcagagcacaaaggggctgacggggggctgaggagcctttcatggacgggccttagcaccaaacagccagagagatggaggacaaggctgaacctcaaagtctgacagtcgcgcaggccagccgggggctaaagttggacaggaacaaaaaccgccactctgaggctgatgtccaagtttctgaggccaagtcttggtcttgagaatggttattccttccagatgaggatgtgggaagtcaggagtcttgaatgcaactgcacccagcccggtactgcaggagtctgaattctcaccaggataaccagagagggctctatggggaacccatgaggaagggacaccatcttcccttcctcagaggccgctgtgcatttgttcctgctgcgagagttcgaggagggtgcccactgtggaggtcgttgagaaaggcccatgctaagggcaggtcccgccaagaatccagcagttcctttcatgcttggcttagagcagggagttctcaaagtgtggctcctcaaccaacagcaacagcaccctctgggaatgtcagatgtgcaaattctcagaccctgtccagatcgacagaaactctagggatggggccaggaatgtggcttttaacaagccctctaggcgattctgaggcaagctcacttggtggccactgtcttacagtgggggttagacaaggcaggcttctagtagggataacctcctcatatgttacatggagttggacctttctggatcggaaatagtccagatgcccaagatatagctagaaaaccgtattcttactgaggtttggctcagaggaggaactattattctagcccaccacccatctgctccagaatgcaaggcccccgggaaaaataaaaccaaaagaacacagaggcccttgtgacaactccattttattagttgagaaagatcatgaaatgggtcgcactactgaatttcagaagttaacagtctcatattgtgacagaagtaaaaacgagaataactgggtcttttgaaagctctaagggatcagcagactaagagaaaataaatataccgctagaaagatcagatccctgcactatgcagagacccagctcacagaccactcctactccaaagctgtccccaagccccaggctccatcgcttcctcctctgggcccttcagcccactggaagcagctcctatgctgtgcgtgttgcaaaccacctttgctcctccgccacaccatcaacagcatcccacaggctgggaccaagtcgaatatttctatcctcagttctcagcacagctcctgattcatggcagggacttaaaaactgtagtggctcacgcctataatcctagcactgtgggaggccaaggtgggtggatcacttgaggccagaagttagagaccagcttggccaacatggcaaaaccccacctctaccaaaaatacaaaaattagccgggcgtggtggcaggctcctataatcccagctacttgggaggctgaggcaggagaatttcttgaacacaggaggtggaggtcgcagtgagccgagatcacaacccactgcactccagcctggcaacagagtgagattctgtctcaaaataaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacttgcaattagacttgtgtcagttcccaccttccccaccaactatgatctttctggtctcagtgccttttcttgctgggaaaccctcccagataactctgacccatgctgaaatgcctcacatctcctacggcaggctggtggcacctgcgcctggaaggctttatgcattgcacctgagctaaaacagtggctccttgcctgtggggggggtcccacagcaccaggtggtcccgatcagggcccaccacaaagcattctcttttttctttctttctgagatgggagtctcactctgtcacccaggctagagtgcagtagtgccatcttggctcactgcaacctccatctcctgggttcaagtgactctcctgcctcagcctcctaagtagctaagattacaggtgcccgccaccatgcccagctaatttttgtatttttgcatttttggtagagacggggtttcatcatgttggccaggctggtctcgaactcctaacctcaagtgatccgcccaccaaggcctcccaaagtgctgggattacaggcatgagccactacacccggccctttcttttgtgtagatgcttcacttgatttctacacggggctctctgtccctcaatgactgagatgggaggttgggggctgaagagaataaaaatgtttgctaatatttattgcttgtttaaataagatttaatgacaggagataattacactaaatggctttattcagtgacttgaatttttttagtatgtgaatcacaaaagggctcgcccctccccaccaatcagccacaatgtcccccagccagaggacaactgagttggtcctcctcattccattcctccatttcttctacatccctagctatgttatttacataggtttactatcactatgctcctttactattaaactgacaaataattgcaagattcaggtatctgagcaccatcgagacgatcaagaccacagaagaaaggaagagggagtacactccgcagatgcctcccagggggagtaactcaggctgtcagaattctacatgtgtgcgggcagtgttcaccacacacacctttgcagataaaaagaatgtggtacatattttagttctaaacataaaatgtccacccaagccaacagagtggtgtgaaagtgttcagatacctggaaggcagtggccacacaggcattcctagaacataagacagcttgtctacagctccgatgagtcagaatgagggggacatcttttcaatacacacatcacacgtacaactttattttcttcctgaatttcctgtcctcctaatctaactgttgccagggactgctgctgactggatccccaagtcatataacccacgtggttaaggctctcaccttcctctactctccattctaggacctaggaggaatggaccattctctacatggggtcagagttgcatgttcagatgtgattccttccctctccagctacgcccaaactctgggatctccagccttctgactggccaaccccccgataagatccctcccgggacatccaagcaattcgatccaaagatgccgcctcctggttggtcagctctccagctcctagtggaatgagactggaaggccggcccgggaaaacgttttaaaacttatttttaagtggcaaaatacagggagaattttcaccagccagtccacactggccaaaacatcccctgcttacactcagtaagttcactgtactgcaggcccaagaaacagtgatgacacaggaagaagccgtggtcgatgatcgcactgggggggcatgggaccggggtggggagcatcgccaatcttattccagacagatgatagtttacaaaaccttctggagaactgtgaggaatttccttcagtaaaaatcaagtcttcagaaaactgcaccaaaaaagctggccgggcatggtggctcacacctataaatcccagcactatgggaggccgaggcaggcggatcacctgaggtcaggagttcgagaccagcctggccaacatggtaaaaccctgtttctacaaaaaagtacaaaaattagccaggcatggtggcacgcgcccgcagtcccaacaactcaggaggctgatgcaggagaatcacttgagcctgggagctggaggttacagtgagccgagatcatgccactgcactccagactgggcaacagagcgagactctgtccaccccccttccccccctcaaaaaactaatgactgggaaaattttctttgagcaaaatggtaggagttggggaggagcaaaggaggtgggtggaagcgaggactagagagaggactgcccagaccctgccaggtggaaagcatcaggacacatcacgcatgctacaagtttttatgtgacgcgtgcacagtggcatgtggacacagacctggccgtgctttctcccggggctacagtattaagatgcagtcaatcgctcaccatcacaccagtgggcaagtgatgtctttttggaatctcaaatccagtagcctgctctgctagccttaatctagtcagtctatggacgcttttatattagtaggtattttaaaggcttaagtcttaaaacacaaatctttcgatgacctttccagatgactctataatagcataaggccagaggaaacagcagcagccagtctcaggttctggtagcactggtatttttataatggtctttcttccggctttgattcattcattcattccccgtgtgtctgtctacattcctgctgcttctttcctcacgctctaatctctccccaaaatgagtgttcatcaatcacctctaaaaattatcctcatcattctctgtacgtgagaaaggcctttcactaaagggtctttatcacccactactcccctgtaccacccctgtctccagccagcagctctaccggttctcggtttccaaaggtttcctctatttgtgtgtgtgtgtgtgtgtgtgtgtgtgtgtgtgtgtgtgtgtgtgtgtgtgtgtgtgtgttgtgtgtatgcacacaggtgcaggctcaggccacttcctcctgtgtacaagtccatgctagatcctccaaattccttttttttttttttgatggggtctcattcttgtcacccaagctggagttcagtggcaggtggcaggatctcggctcactgctacctctgagtcccaggctcaagtgatcctcccacctctgcctccagagtagctgggaccacaggcccgtgctaccatgcccagctaatttttgtatttttagtagagatggggtctcatcatcttgaccaggctggtctcaaactcctggcctcaagtgattcacctgcctcggcctcccaaagtgctgggattacagcattagccaccgtgcccagcccctgctcctccaaattctatcctcctttctaagcatctcacctcccgccctttttctgtctgcagcgatcctttctcctctgaactccaagtcttgggctctcagcacggctatgggcactgctgccctgagtgctggtaatcagctttatgtatgtggcacaccccccagtgagactggaaggttcctgagggcagagatgctatgccctcctccctggggattgacacacaggagccacgtcattctgcagtgagaacatgggaatgggagtgagcagccgtggagaagagggaggactgacgctgagctttctcttccattgtaaaaggaggaatagggccacctacctcaccaggggccatgaggcttgagtgagaaaatcagtatgaatgaacttccttaaacaataaagcaaaattaaaacaaaacagctgctcaggtgacgacaatgggtggaaaggggaacttgaagattcaggacgcctcccctgccatctgatttcatcagggtcctaggactgactacacaaagaggaattgattacttgatcgtccgttcacttaccttgctaatgaaatcattgggtttttctggggaagaacctgttaggaggactggcttgcctctgggtgtcagtcccgctggtgccagctgcatccccaatgccaacatgactcatgcgatgacacaaattgccattgggctttgttattatgtgaccttcagcaagttacccgcccgtccctgctccagtgctaaaatcagcacggcgatacgagaacctacttcaaggcatcatcatgaggaacgatgatgaagcagctaataatgactgggaaacactttgtctttgtaaagagccatattacttaacatttagaataatacccactgtttcaggttgagaaagcattcagattttagctaaactgaaggctgagcacatccactaatgagcactgtccttcccatagaaacggcgaaagctactcagtctgctgaataaaatgactagcagtacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataatgtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtctcaactactcaattctgccacggcagcacataaaagaataggcatgactgtgttccaataaaactttatttatggagacaaatggctggctgtattccctcctctggcagtgatatgctgttccctgacctaaaaccccgtaacaaatttatacaatcatttagaaaaatcacgcgcctgctctcaataaagggaacatatacattatctttctctcacacacaccctcttaaacacactctttgataagcaaaataagtttcttacaatttttgaaactcaagttaagagccaggctcaggccgggtgcggtataatcccagcactttgggaggctgaggtgggaggatcgcttgagctcaggagttcgagaccagcctgggcaacgtggtgaaaccctgtttctacaaaaaaatacaaaaattagctgggcatggtggcgtgcacctgcagtcccagctacttggagggctgaggcaggaggatcacttgaccctgggaagttgaggccgcaatgagccaagatcgtgccactgcactctaccctgggtgacaaagtgacaccgtgtctcaaaaaaaaaaaaaaaaaaaaaaattaaaaagccaggcttgcaaacttcatatgcaaataagctgtttcaacgtgaaagtcaacacctatttaagagccatttaactttcaattacgaaatgaattcagaacaattcaacttcactgcttgttttcaaggctttcgaacctaactttctcgtcagtgtgctcagtcacagggcactggttctcaggttctgcatctcactctacaatcaaggtaaataccaccacaggaataagggttaaggttatacacttattcagagcttaacaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtgatcaggaaatctggattgagaaaaatgaagtatttaggtgttttctcaataacatcatcttacatgtacacagtcctgcgtagatttcaaagggtttggccattacacagctcaaatgattctcataagcaccttgagacattaggcagtggatggcagcgtggcagatggctttctcctctgtttaatggacacaggagagagataatctagagatggcaaattggcagtggctgagaagcctgcaggtgggagcttcataaccctcgggagtttttaaaaatgcttaattaatggtgaacatttaaaaatctgccaatttcccatacaatcaagattttttgcctctttagacattaaaaaacaaaacaaaacaaaaaaacagggtttctggctgtacattccctcatgtcagcaattacctagaaaagatggtgcaggagccctccagccccacaccagttacccacttctgatacctgtatggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagccagcttaattctgccacaggagttaatatttgttaattggtagaaaaaggtaaaattaatgaggaagttagcatagctatttaaaaacagctccatgtttcccccactgtaacacatggaactatcaggaagtaattgagggaaaaggacactgtcaattctcaattatctgcatgaatgaagcgctcagtgacacggataatccaagtcacttacatttggatttagaaagtaacatctttttccttcggaaaacttaccttcctaattagggcttgctgaatgcagtggcgaaatcagtttaccttctcggtcagagaaacaacgtgtcggggaaggtttggaaacggctgggcatttcagaccctccgcggataacccagggcagataaaagatcattcacagaggctggccaatatagcagccactagccacatgtgactatttaaatttaaattaagttaaataaaatgaaaagttcaatccctcggtgacactagccacatttcaagtgctcgatggccccgtgtggctggtggccaccacgctggacagcacagatcacagaacatttccatcatcacagaaagttctagtggacggtgctgaattctagaccaacaatcacatctagttacctggattaagtagaaagcagagggcagggggagagggatgcgggagacgtcacactgccactttagaaacaaaagggaattgtaactccggactctctcagctagtttaatttcaagcccggtaatgtagacgctgtctagggaataacataaaaaataagcattccattctaagtaaaatgaggctttttaattaacaaagcagaaaacgggaggataaaaggcgaggcaggaaaggctgattttcagcaaacatgtgccattgctgcctgtacccagcatggccatgcagcccagacgctggctgaagggtagacaaaggcaggagctcgaccctgccaggctccgcgcggggaggtgcctgctcaggtgccgctgggagcaatgtcaggcccagtgtcacttaacatcctcattaattatcttgaaaggagagggttagtaaacagcaagttaattaaattctcagatgatgctaatttgggaggctttagaaagactggcaagggcagtggcaatataaatgggacctgggtgggttggaggtatgagtggaaataacattaagcgctggccaaacgctgctcttaaataagtcttatggaagagccaaaatacatctgaaaagaaacttatttggaaaattgttgcaggaaagctaaaaggttggaagcttctaaggcgtatgatcagaatgggagtcaaaaaggctttttaagactttgaataaaactgtttacgtgcacttagaggtctgggagaaacagcagctcctaagggttgctgtccttgggagggaggataggagcgaatggggagcagggatggggcttgcacttttacttccttttcttctaaatgaattaaagatttttattattattttattattattttttagacagagtctccctctgtcgccagcctagagtgcagtggggccatctcagctcattgcaacctctgcctcccaggttcaagcgacttcccggcctcagtctcccaagtagctgggactataagcacacaccaccacacctggctaatttttgtatttttagtagagacggggtttcaccacgttggccagaatggtctcaatctcctgacctcatgatccgcctacctcagcctccgaaagtgttgggattacaggcgtgagccaccacgcccagccctaattaaagatttgtaaaacaggcctggtttttgaattctgattttgaaatttttgtgtctgaaataacattagatttatagaagagttgtaaagatacaatgagttcccatgtgcccttcacacagctgcctctaatgtcaacatcttccatcttaacagctgggacactgtcaaagcaaagaaatgagcattgctacaatactatgaccaagctacagactttattcagatgccaccagtttttctactcaaggcctttctctggtccaggatccaaaccatgtccctgcatagcactgaaatgtcattctcctccatcgcctccaatctgtctttccttgtcctgaaagacctgggcgcttctgacaggggcaggtcagtagaggacccctcagtgtgggtttgtctgatgttttctcacaattagattgagattatggatttctggagagaatgccaccaaggggaaggacccttcccatccaccgtatcacatcaggggctatgtgacatcaacatgacccatcactggtgatgttgaccttgatcactttgttaaggtgacatctgctgggtttctccaagggtaagttaacacttttctttctccagactttactcattaaaaagagtcactaagcccagcccacacttaagggcaggggagtgaagctccaccttctggttattacgctgttaataaaataaaaacatctcgtaaaagagataaacttctctttatgcaaacaaaggtggctaatggaaatgtctatctagaaagtcagagtttgttgtctttgttttgcatacctgggctctcgacaatggaaatgaagcaatgccaagagattcagggccctcacagtgccaggccaggtgctgtgtagctatagatattagcccatttaatccccaccacagccagatgaatgagatggcacaagattacaacaatcctcccaaatgacagtaggtgaaatgtggaaccaagaggttaaatcacttgctcgtgttaacacagctatgaagggacagaggcgggatctgaacccaggccccctggctctagagatcatgctgtctagagacctctctgctatcctgcttcttgatatacaactctgaaatttcagggcagttaaaatgcggcagcaccatgtcactcccacagtggcactgtgagtgacagcgctaaggaggcccaacaaaaccaagatggtctggagggttttcaacagaagacagtccgccttcatctctatagtgtggcagagaatccagaacacattagcttggctaaggacctccctctctacaaacaggtatggaagaagctcagaacccacagaccacgatacttactcccatctcagcccctatctactacagacacaaacttggaactgtctccaaaaacatttagagttcactgtgacaaagcaataaagctcagaggtcaggaaaaaagcgatcagcaggcagacttgggggagaaacttggcccacaacacccccgatctacaacctgcaaatatttactcatgggcttgtttaatcctaacatttgatgttctgacattaaaaaagaaacaaggaagctcttgcttctagagaaacaagaaaggaacaaggaatgtttgggtaagaactgctgcattcttacccaaaagaataacataggctaggctgggtgcggtggctcatgcctataatcccagcactttgggggctgaggcaggcaggtcacttgaggtcaggactttgagacaagcttggccaatacggtgaaaccctgtctctactaaaaatacaaaaattagttgggtgtgatggtgtgcgcctatagtcccagctactcgggtggctgaggcaggagaattgcttgaatctgggaggcagaggttgcagtgagctgagatcacactactgcactctagcctgggcgacagagtgagactccatctaaaagcaaacaaacaaacaacaacaacaaaaacacataggctaacaagtagcctacgttattcaaaattcaaaattccagtactgatctttaccatcatcctgtccacagagaaaagatgatgaagtgtgtaggaagcaacaaatgtcccctacctgcacacccgccccacactggattctccaaatatctggcatttatttctcctccatttaaccctgtcttttgttttcccattgtgtcaactgcaaaaatttgcctttaaaaaaatgacactaataaagaatcacaccatacaaattctaatactatattgatcccatcagtgactgggcagacagcagatcttccatcaacacctagactcgcagaacacatcaaacagaaggctctcgacacccagtgtccgggatcagcgtggcgggcctctgctccaacctgtccacccaactagatctcaagaggaaaacagaattgccacctctcaagactgaggctacgtgcagtggctcacacttgtaaccccggcactcctggatgccaaggctcaagaggagcccaggaagtcgagaccagcctgggcaacaaggcaagatccagtctctacaaaaaataaaaaaaattagccaggtgtgtggtacatgcatgcctgtggttccagctactccggaggctgagggaggaggatcacttgagcccaagaggtcaaggctccagtgagccgtgtttgtgccactgcactccagcctctgtgacagagcaagactctgtcataaaaaaaaaaaaaaggctgaatttcattgtgattttaaaagcacatataatcattttataaaatgcagaaaagtgttattaataagttaatctctgagtgcttactatgtgccaggcacagttccaacgcccattctaagaatcacccactctagacgtaactacttaacatttcaaagtattcttttccatgcatttcaacgtttcacttcagccagaaaacataaaatagcattgaagagaggcatattttctgatttttaatggcatcagaagctggaaatgacggactggaatagtatacgtggcaaaaatctaaaataattaagaagatgtttgtaagcacttagaaaagagagcagtgaatcacttacagagcaagagactgacttcttccttgactcttcacttcccccccctcctccgcctttctttttctcaaataaggtgactactgctgttattactaacaccgaactgggagatcagggactattaaagattaatgacatttgattttgtatctcatgatatgcttgtgaacaatctggaatggggggatctaattatactatggtaagaggtctctgtacttaaaaatgttggcccagagaatgctgatgataaatcaaagtcaacatggaggaaaatgcctgcagtaaaatataattatccaggtggacctctcctgtccagcgtttctaataagatgtgaacagagacagaagtcatgcctatcacccaacaaagttagtcaaaaagtcatatggggaagaaacaggtgaaatgtaaatcatttgtacgaattgactaacgaggattattatattttaataccaggcagtgcaaaactaaacaatggagacagttctgtatggccccaagaaaaggcgaattaataaaaaaagaaaatgtctagaaacagatccaaatgagaacttcatgtatgatatagtggcatttctaggcaccacggcaaaggatgggtagattgcttaataaacatggcagggacagataattgagaaaaaaataaatagaggaacccctatctcacagtatataccaaaataaactccagatggataacagagttaagtgtcaaaacatgaaaccatgaaagactaaaaggggatggagtgaatgtgatcttggcaggggaaagacagttctaagcttaacaaagcagaagaaggccaggtgcagtggctcacacctgtaatcccagcaccttgagaggcccaggcaggtggattgcttgagccaaggagttcgagaccagcctgaacaacatggtgaaaccccatcgctacaaaaaaaacacaaaaattagccaggtatcatggcacgcgcctatagtcctggctattcaggaggctgaggtggaaggattacttgattccagaaggccgaggctacagcgagccatgatcacaccactgcactccagactgggtgacagagcaacaccctgtctcaataaataaataaacaaacaaaggagaaggaagcaaaaatgagaagttttcgccatgtaaaatttcgaaactttggaatctcaaaacataccataaacagcaaaagataatgataaactgggggaaaggtagacagtaacacaaatacataaatacatgtttaacacctttgatagagaaagagctattttaatttgtttatattatccatctatgaacgtttaatttataacagtgaaaaactggaaacaagccgactatcaaacgcccagtaactaaattgcagcaccttcataccacggggtgtttggtgcagctatcaaaaatcatgttgtagaaaacatctagtgacatccaaaaaaggtcacacattgtaaagctttttagaagccagttacaagatacacacagtatcatttcaattctacgaaataataatatcacatctgtacagaagaggccaaaatgacatataccaaaatgtttaaaatttaaagcatcttggtagtgaaattagggatgattttttgtgtgtgtgtctctgcatttccaaaattttttttacatacaataaacatgaagcacttttgaactcaaaattaataaaaataattaagtggaaatatatatgtgtgtatataaagacgatcaccttactgttacattttcagatattataaacttgagagggcagccagctagcccactgagtcaatggaataaacacgatgaagaaaaacagcaataaatgtcaagttccttccccaggttgaggggacaaggaggcctggtttaactgtcagttccatgagggcttgagatggctgcttaataaaagactagaacattaatgacttggtgtctatatcaaggaaagggacagactccctgtgatccacacgagtgaggcctcgccaaaagaccacgtcccatcaaaggcatcatcattcaagggacctgtcaacaagcaaataagtcaaaagcagggggcaaggatggtaaggggtttggaaaccatataaagaatagtcacaagtgcttgagatttgcattcaggaggatggggacggtacatacacatgaagacaagagacaagaaaaggagggacaattagctaaactgcttatggcatcttcatacaataatactacgcagctattaaaaattatgatggaaaaaatagtgacattcaaaaaatcaaatattgcaaagttttaaaaagtcacaaaaaccagtatcctttaaacacttacaaaatcatcatatcacaaggaagatgtctcttctagaagaggaacaggacaaaagtatctctacccctgcaggtaactaggcagccagtaactcaacataaaggatgggctttatgataattaaaggtggccctggactcctttgtataaagaaatggaaatgttcagagaatctctatgacctttgtttaaaggtagttctttttttttttttttttttaaatggagccttgctctgtctcccaggctggagcgcagtggtgaaatctcggctcactgcaagctctgcctcccgcgttcacaccattctcctgcctcagcctcctgagtagctgggattacaggcacccgccaccatgcccagctaatttttttgtatttttagtagaaatggggtttcactgtgttagccaggatggtctcgatctcctgacctcatgatcttcctgcctcggcctcccaaagtgctgggattacaggcgtgagccaccgcacccggcctgtttagaggtatttctatacgatgttcctttgctgggttcagtgtgttccctaaatgcgggtagatgtgcctggaggttgttaaaaacacagattctgtgcatttccctaatccaggctcacaggatcagtctctcaggcaggacctcagctcagattctgtactttttttttttttagagacagggtctcactctgttgcccaggctggagtgtgcagaggtatagtcacagctcactgcagcctggaactcccaggctcaagcgattctcccacctcagcctcccaagtagctaggactacaggcgtgcaccaccacacctggctaatttttgtatttttttgtagagatgggggtttcaccatgctacgcaggctgttcttgaactcctgagctcaagtgatctatctgccttggcctcccaaagtgctgcgactacaggtgtgagccagtgtgcccagcatattttgtacttcaaagggttctctcactgattctgacgcacagctaggtttaagaatccttgagccaggtggtatctttatttttaagaaagatctgttttgtttttttttaaggcagtacagaaagaaatgtataaatcatcacattctatcactaatgtgaacattttttaccaatatccatcttgatatctcctgtctatctatctaaaatatacctccaattttacataaacgcaatgatctgtatatgtaacatttttatactatgttgagagaggccgtctttccaactaaaacatgtatatgcaccatcttttttttttttttttttttttttttttttttgagacagagttcttcactctgttgccagggctggagtgcagtggcacgatctcagctcactgcaacctctacctcccaggttcaagcgattctcctgcctcagcctcccaagaacctgggattacaggcacccggtactatgcccagctaattttttgtatttttagtagagacggggtttcactatgttgaccaggctggtctcaaactcctgaccttgtgattcacccgccttggcctctcaaagtgctgggattacaggcatgagctactgcgcccggtccctgcatcaccatttttaatacctgcactgtaagccacaagaacatgctgtaattatcttaactagtccaactgaagaatttgccaacttaaaaaaaaataaccaaaataaacaatgttgtgaagaagagcatctcatacatatcaacacccagaagtcactgggcctcagcacagaattagcccactttacactgtgatagctatcagtggaaaaattaaactaatacacacagccaccaacagggtacatgagcccctggattccattatgattaggaatataatcaacttaaagaaacacaccaaccaggtgcagtggctcatgcctgtaatccaagcactttgggaggccaaggcggtggatcacctgaggtcagaagttcgagaccagcctggccaacatggcgaaaccccgtctctactaaaaatacaagaaaaaaaaaaattatctggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggacgattgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggctttcctgttcttcaaagggcatcagacacgactatcgctcagcatgaaggagatacatagggctaagtgggaagacggcgcaatgcaaaagggcagaggactgaacggggatttgggatgcttgggtgctagccaagaaagactccagaaaacaatcagagggaatctcactttcatttggctttggggctattcttattctctgatgaaagcaccttaacagtacggtgagaagcatgatggagacagttggcgtggcctcgccttcccccaatgcttcgtgcagcaaatgatcactgcatgtacagaaggggatcgaggagtctggagagaaaggacggggcagagagaaaagggggcagtgcctggctcggcgcccagcgtgctgcatgctggtttcaggccccaggaagctggcgggggccttgtcctgagccaggaggagacaggccttggccggtttcctagcaaccctcaccggcagcaggcagtaccccaggcaaggctgtccagggaaaaatgaaaatggccacacgcacagatgcaaaacgaaagcaggcctgcctcccagccgggtgcggaggcaccaggggcccctgccagacagctcccacaccaaactccttggagaaacatctgggggcaccagccatggagggggtctcacttccttctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggtgaggcccccctgtcccagacaaacaaccttccctttggcctctgtcacttgttagttctctatcagctgaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacgaccgtcactcccagcgctctcttcgtacctggctttcttcctttgaaattgccttgtgtgatcaaaaatgaatcataaaacatttgtttcagattgttacatgctgtacagtttttagaacaggatattctattttaggatatctaatcctaaaaactctgggaggcaaacaccttcactttacagctgacgttacagggtctgaggctgatacctgtcagggctggggacagagcagactctccccagcctgcttcctgctctgtccataccaggctcctcagattagagcactaagtccatatatggtaaagctgctagaaggactcgacgaaatgattagtatctaaggcactatactatacatgaaaattacagcaagtatatccacacatacacacacatcagagtatatgtgtatatttttaggtatatgtgtatctatgtatatgttgtgtacataaatagaagctggcatctatctgtctacaacaagaatagaagatatgaacatagggctgggtgcgttggctcatgcctgtaatcctagcactttgggagaccaaggtgggaggatcgatcgctcgagcccaggagtttaacaccagcctgggcaacatggcgaaagcccatctctacaaatgatacaaaaagttagctgggcggggtggtgcatgcctatagttccagctactcgggaggcagaggtgggaggatctgtagagcctaggaggcagaggctgcagtgagctgtgatcacaccactgcactccagcctgggcgacagagtgagacctgtctcagaccagaaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtagtagatgaagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactcaagttcagcagtcaaaatgctataaaacacactgttctttcttcttgttatttatttattaacatcaaggagaggctcacattttgtctttcagagttggttgcaataggttagacctctttgaagccacataaaacaattcactttgtattatgtaactaaaacttaaacgactttagatttgatgacgctatactgctatccctccttgttccctgcaacccagctccctctgttaaacagggcagctctggggcaacaccgcaggcccttcctaggaatagttcaagaaaacagcctctgatttcctacaaggacggtcactgactgtaaaactacaagaggaggtaagaaagtactacagcccaagggttcctcaacccaggctcctgttatacacctgcctttgtgtccacagtgaaaacaacatggaaggaactggttatgggttttgacataagttgtttcaagccagcagatgggatgagatgctgcttccatgacaaagtcaccctggatattctcaggccgaatgagggtgagatggtaccaggcccacagagaggccgcggctgggtgcgcagaactacgacaccagccctaagaagccaacaggctgttgaatgccaagcctgaactattaatttgcatatgacatcaattctgctgtcagtgtgttaatgtgtgattaattctgtcatgggttagagcaaggagaattagttaattgtcagaaacccttctcgttcactctcgtttagcccccgcctccctttaacttccttttttctcttcttattaaactaacctcctgggttttcttcctctgggcacttctgtcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgcggtcaactgccaatgccagtgatacctggatacattgtacaatctgtgctttgtgtgctgtgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggcccctgaatgccaggaaatttcaggaggtacaggcatgtcacaggtcaggctaaatggtccccaaccaccgcagcaatgctgcatacgcacgctgtggggtcaaggacaggtgatcctgatggtcacatttcccaggtttgctaacaggcagcccatacctgtgtccacttaaccccgtcccgtgtctttcccttatcttgagttgcctttcactttgaagcaatgaggaaaaaggaatgaatgaaagcaaatggacccgcacaatcatctacaatagtccagaatttgtctaatttatagggctgggaaaccaagtgtcaccttcgggcctactccttccctgaccaaactgcccagaggggctggaacgggcaccagccaagggtgggcagtgaccatagcttttacgtcctcttgaagacaggaggaaaatgcaaagaggcacagactgctactcccctgtcccccactactcattatataacacatgtcagtttcttgaaagggccctatatttgtgcacgaaagcatgttcccaagagttaacttataattattacaatagagaggaagcaggtaactgagacctattttcacgttacaaacaaaattctgtgatctatttaaaaagcacaggcctccctttttatcttggaagtcactgtttcttttaatttggaaacacatctatcaactgaaacctttaaaaacttaacaaggaataatgttgttatgggtcatgattattctaatgtcttatcattttattttgcatatgcccttatagctaaactcaaactagatgctagaatataattgcccatagtaaccaactaaacagttcccctaagcaatgtgtatttttgcgtctctgtctctctcacactctcactctatcctgcccgcccactcgctccccttcccaagtaacaaaagccagataaatccatggaagaggtgaaagagctacagcgactccactttccaaacacttgtgtgtattacaactctttaaaaatgaattacagaatccactttgaaaaacatattcgggcccttgtggaagttaccagtcctttctcaaatgagctggaagtgtctctgatcaacatgaattggggttccttcttccttttcggagtatggatactaattgttttaatatgggcattattcgcacatgaaactagaattgctcagcacgtgggagataggtcccgaccacccatgggcatcaaagatcccatgacatttctgtaaatcagccaaattccaacacagacagcaggcccagcagttgctgtattcagatgaggggcgattacatgctcctgcctctcctacacaaagcagagaccaatgtttctactcctggcccgttctctgggtctatcctggccaacctcctctgggcacagcccatcagacctccagatggctagttctctctagaccactgacatcctacacacaaaggattaccaagaagccagctcccccaggtttacgaaatttataggaaagtctccaatcaagaggtcaggagacagagaacagggtgttaggaaccatgagctggaggagagtcccagcataggggcttctcagctgttctcacttgaaattacctctaaaaatctatttccatatttcttccctggaatttcacttttagaatttgaacattcagaaccttcaggtctccactccttcttcacttggtcagagaatttcacttggtcagtttcacttggtcagacattggttaaaataaaataatttccatttttaaacagtagtaaaaaatttttatttaaatttgtttagacccacaccaatgagtcttctccctgtgtcacagtaatccttcctccttgtcttccttctctctcaatttctcaatacccatcgagtctttccttaacaatcctcccgattcattctcccgctgggatggccaagttcttctgagggcaacacctgctccaggccgtgcccccttggcctcctgatttgccttggaatctggaataagtcagttcttctccaggtgcaggtgatgggggaagtgacatcacacctcacaaaaggaggatttgggggaacgttcagccaccgatgccctcaataaaaatatctcgtgacttggactcaaaggcagtggccttcccagcggcccgcgaggggctgggaggttcccagcatggcactggggctggcagcaggccctccgcacagccccccgcccctccggagccgcccgggggagctgcagcagcctctctgcgccaggcacactcccagcattgtgctccctccagcgcgctctcccccaccaaaaaccctgaggcctccggagtgtacactaaccacaagcctttgagtggctcatgtatttacaaactgaggcatgtcgaaatcaaaggggataccacatgacataattcgcattaaaatgtcaacaggctgacaatttatagagtcaatccacggaaggtggggaggactaagactcagtaattgtttaattcctgctgaaacccacggccactgtgcctttggaagctgggatgcgccagaggcctccaggctgcacagtgccccctggggctggcaccgtgccaaggccaggcaacgggtttaaccatttagggtgctcaatgatgtggaggatggggggaggggagggggaggggagagagggagggggaggggagagagggagggggaggggagagagggagggggaggggagagagggagggggaggggagcgagggggagcgaaggggagcgagggggagcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcgcccccaccacaacccctcggcccaagtcttggtttcctggctgttctctggcagcacccggctcaccaaggcaccctaaggaggggtcagcggtgtttatgataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaatcccagtagggaggatggcttgaggtcatgagttcaagaccaacctgggcaacacagcaagaccccatctctaccataaaataaaaagtttagctgggtgtggtggtatgtgcctgtagtcccagctgctcaggaggctgaggcaggaggatggcctgagcccaggaggttgaggctgcagtgagctaaaattgcaccactgcactccaggctggacaacagaatgaggcttggctgggtgcgggagctcatgcctataaccccagcactttgggaggccaaggtgggcagatcactaaaagtcaggagttcaagaacagtcaggccaacagggagacactccatctctactgaaaatacaaaaatcagctgggtgtggtggcacacacctgtaatcccagctactcaggaggctgaggcagaaaaatttcttgaacctgggaagtggaggttgcagtgagccgagatggcgccactgcactccagcctgggcgacagagccgccagaccctgtctaaaaaaaaaaaaaaaaaagagtgaggtaaaaaatcaaattcttactgcttaactccacctggatttttgatattggttctacctatatgttaaattaactgacccttgcttggggagaggtccacccgggggtgagggactggtgaaagggatgcaaaagctaagtttgaaaaagctctgggggtgaagtgtttgatcagctccctcaaatgcaccccaagctctaagccaagtttaatcttttcatcattacatgagaacgatatgtctagagaacacaaatggtagaaataagactatttggcaaagcttacaggtcatcatcaggatctgcattcctcagccaggaaaaactgtgttctgaaaggtggcctcgccctgtggctcttgccccagaggatgcctggggccacgcgggctgcgacagggccctccacgcaagctggctgtacataaacagtaacacctcattctctcttctacctcattaaccgaaacacattaaaacaagtgtgcactgggagcagaaaatgagactgttaaaccaagctgacataatcctcatcagctgtgggaaaggagaccgcatcaattatgctgaaccgaatgcagtcacatggatgtgctgggctcccagccccccagcatgaaaaggaggacaagaggaaaagaaacgttcacttaaaaaagaaaacaggctgggcgcggtggctcacgcctgtaatcccagcactttgggaggccgaagtgggcggatcactggaggtcaggagttcaacaccagcctggccaacatggtgaaactccgtctccactgaaattacaaaaattagccaggcgtggtggcgggcgcctgtaatcccagctacttgggaggctgaggcaggagaatcacttgaacacgggaggtggaggttgcagtgagctgagatcttgccactgtactccagcttgtgtgacaagagtgaaactcagtctcaatagataaataaataaaataaaataaaataatatacttcatactctcctaacaaacacagcttctcgcccatttttgtcaccccaagggaggggagcggcatctgatcaaaacacccctttatggttcttctgcacctaaaaatctttgccaaactatttggaattggaggggaaaaaagaaaaataaacataagcttaaaaaaaaaagaggacgggcgataaggagataatggattctgtgtgatctcttgcagacagattttataagtgcaaagtatctcgaggcccaaagtcctaagacccgaaatgatctgaacacaacccgcttgtgacataatggcaaggatgcttcagaaattaaagggctatggagcagacaatagcaattgaaagctacacagctataaaacacagccagcacttagctctttcagccactgccaatagtgaataacagatcagaactgatacatttagaaatactcataaaacctactacggaagaaaacaaaaataatgcctgtacattgccaaaataaggaagattacggttctggtaagaataaatgaccaaatcattacctacacgtaagaaatgcaaaagacttgtatatgacagtcataaaatgtaaaatgtggtacaaggtgccatcactgagccgtaccccacatcctggacgttacaatatcatatttgatagtaataactaactcacgtgaaatgagtattgctatgcaaaactttcttttgcatttcttcatttgtgttcaaatttgcaaccttaacatgtttattgccactgatttgcatttcatttcataggtgaaagtttccaaacataagctgtggacttatttcttatacacctcttgacaccagcatgaaacgtatgttgccaaaactcagtcctcctagtacccattcaattcaccattcacattacaaagagctgctctgtttttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacacacacacacactcttcagctttcaaaagaggtcgggggaagggagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgtggttttcgatacaaatgaactcacttatgcaacgagggtatgtgagctttgcaacaccagctaacactcacttgcgtccagaagctgttcccccttttacgatattctgtggtattgccaaggttacaaaatgtaaacagatacaaacacgaaccataacaagaaccaaagtcaaatatattctcgtttttccatctttgtcctctaagctgtgtatttctagattgtggctttatttttttagagtgaatatgcactagctttaatcagaaaaatatacatgtaagggaatgaaaactaccaaggagtatagttcccctgagtgtcctgtgtactctatgccagtttccaagcctacgttctaacttgcatctaattttggtcacataagggaaatacatgtgtgttgatgcttgcaggaagtcctatttaaaaagaaacaaacaaatactgaaacctcccaggttatgtgggacaatatgataaaattatgtcagtgaaggtaacatcatttccttctcacaacggatgatgtcttaggtacttctcagggaaggggtggagcaagccatagccacaatgcagctggacttgaatcactttctaattttcctgagtacttcactagatcactttttgctccattacttaggagaggagatggagatatccctttgggaaaaaaaaaaagtcctacaaacacacacttagtgcttgaaggagacttagtgaggaatccaagctccacctccttcagatgaggccactacagattggccaaggttaaattactggctcaaggtcatttcactaaacatcggtcataatctctcttcagggaaattccatctccctgctccgcaccaaaaaaaaaaaaaaaaaaaaaatccactgacctttccattctccaaaccaacagcgtgtcaagttcaaagctaattaaaaccaaattataaaaataacgtcagttgtgtggtctaagaagacgatgggaaatctaatgcagaaaagcagagtccttaacacctttctgatgctatatgcagactgcgtctaggtgcatttcatgtattatctcatttaagtcattcgagagtcctatcaaagcaagtcattctattagcccattttacagatgatgaacaaacaggaattaagtcccaggagctgggattcaaacccaggcagcctgacaccaggcatcttctccctccttaaaaccccaagagctatctgggtttcctttaagacgcatggacatcctatcttaaatttttctagtctgcagcacccactgagccccactccacctgccacaccaacatgtgcccggcatctcgtgggcatccagacacctcctgaatggtcagatcccattagatttccatggcctctcccgcagtagcttgagcgctcttaaccaggtatgttactacctctagtgaaatgtatgccctcgtctgcaaaaacagaaataaccaatctgagccctgtcttcagagacacaacagatcatcattactactctcccagaggagtaggaaggtggaggggaggacagcagggattgagaagagacctcgaagcttctacacagtggagccgagagaggagagaacatttcaccattaggttttagtattttaccctcacattgcattatgaacatctccaaccaaggagatgagttgaaaaaaaaatcatacagtagacacttaagtatccaccacccagctgctgaaattaatgctttgctgtctattttacagccttctctttatcctgctatcaatgtgccttacatcttttattcattccaaagtaaactgcagaagcagtacactccacccctccccctactccagcatgcacagcctcaactacagttttctttttgtttatgggtttttattgtagttttattattttaatagatcacgtgagcagacttcctgactagcaaaacactaaaaagacccaaactccagtgtgttgttattatgaaatgtttagctcacaactttctttttttttttttttttttttttgagacagagtctcgctctgtcgcccaggctgtagtgcagtgtcgcgatctcggctcactgcaagctctgcctcccgggttcatgccattctcccacctcagcctcccgagtagctgggactgcaggtgccctccaccacgcccagctaattttttgtatttttagtagagatggggtttcaccgtgttagccaggatggcctccatctcctgacctggtgatccacctatctcagcctcccaaagtgctaggattacagaggttagccaccacgcccggccacagctttcttttaaaagttagagtaggctaggcgtgatggctcagcctgtaattccaatactttaggaggctgaggcaggaggatcacttgaggtcaggagttcgagaccagcctggccaacatggtaaaaccccgtgtctgttaaaaatacaaaaaaagttagccgggcctggtggcgggcgcctgtaatcccagctacttgggaggctgaggcaggagaatcacttgaacccgggaggcgaagcttgcactgagctgagatcacaccattgcattcctgcctgggtgacaaggcgagactctctcaaaaaaataaaacagagtagtatccacaagtatgtgagaagaagttccagttattaaaattattttagtaccatagccacaggttcagtaagtacaagaatgaatctgcctttgtcctctgtctagttcacctttctatatgattctaccctctttaaatcttgctcaaactccagcttgcccctccctcccagaggtctttttggatctaaccagttgggtgtggctgctccctcccttcaccttcataactcttgtgtccgcatttgacggctcttactgaatgatcaattcctctttgtattacgtatcacagtaatacagtttcttaaactgtggatcatgacccattagtgcagtggttctcaaactgcagccgcacatcagaatccgacagtaaatgaaaccacaacctctgggggtcaagccaggcaggcgtagttttttaaaggcccctgggctaagagtcgctggattacgaaatcaggatcatgtcaggggatcatgaaatccatgctgtgagtacaaccagcatttgtaaaacaaaacagaattgaatgtaatagaaagcatcagaatgtagcacctgcagtaaggataaaatcattctgcacaatttctgttttagtcaaatatacagaatatctagctatatgtatgtgctgggtcactcatgtaaaatgcatttctttttagattatcgtcaacaaagtttaaaagtcactgccctaaagaagcaaggacgttatcctgcgcatagcgggtgctcaaggacgtgtggcttgtacatgggacaggaggagagaagcaggtcagagcttctctcactgggaatatgttctgccaccaaaaatgtggttctcagggcgggggacaatcagatatgggactaagtaagcatcattcagacaaagacgctcgcccaaggataagggaacgaaagcaggagaggagcctctagggaaactgagggaggaggcgactcggggctgcccctaatctttaaatttctatgtttaagattccgtcttttggccgggtgcggtagctcacacctgtaatcccagcattttgggaggcagaggcaggcggatcgcccgaggtcaggagttcgagaccagactgggcaacttggtgaaaccccatcactactaaaaatacaaacattagctgggcatggtggcatgtgcctgtagtcccagctactcggaaggctgagaatcgcttgaactcgggaggggggggttgcagtgagctgagatcacgccactgcactccagcctgggcgacagagtgacactctgtcttaaaaaaaaaaaaaaaatccatcttttgccatcaaatcatcaggcgacacttgctgatagtctacctaatatccccaagaccctgggaaggctacaaagttgggtgagaataaacagatcccaccggtaaggatcttacaactaagcagagaagaaagaccactaaaaatatggtctatcataagaatgggaaaggaacaaggcattttgatgagagtgctggggagaaagagcagtgattttagttggcagaatttgggcggacagagccgaaactcacgggtggccagcagcacgtgggaattttcaaagtaatttgacaccagctgcatgatcttgccagggctgtgtctcaggggtcagtacaggaacagagctgtgtgtgaagctgatggtaaatgacctgggctgcagaagctctgcaatgacctggtccacacaagccatccactttacaccaacatatgccttagggctctaccttatgaaatgccaagtgtgcgcatgaggctgttgtacctgttctagcacagggcagaagcacggcatgctctgctggtaccctatggttcaatatttattgagctggtgtcacacactgttctaagcattagggacagagctgttaatggggcaacgtaggtctctgctgtcttggcagacaactaaattaatgaacagacaagaaaaataaatataatcactgtcaatgcagagaagttatcttgagtgaagtgatggtgtagctccttgagactgggttgtcagggaaagcctctttgacgaccagatattgaatgagagctgaatgtcaaggtcaaggaggtacatacactcagtagaacagcaagtgcaaaggccctgtggcaggcgccagcttagcatgttgaatgaacagagaaggctgctgtggctgcagtgtagggggcaaaggggagagggttgtaaaatgaggtcagcatggtgggaggagttcagatcacaaaggagcttgtaagccacagtacaaaggtgagcttttatcttaagtgaggtggaaagcctttgtggggtctttgcaagagagtgatatgacctgattttcctcttcgtaaaatccctgtatggagaggggattgtaaagggcaagagtagaggcgggggagagttgaaatacagagagacgatgggggctggcctgggagggtggtggtgcaaatgtatttttgaaggaagcacccacagaacttgctgatggtttggctgtaggggagcaaaagacaaggagccccacagatagttcccagctttttgggttaagcaaatgatatgctggaggtggccctaaccgagatgggggagcccataagcatttgggggttctggtcacagagtcctttctgcaccatgctaagcctgcggagttcattctcagacattcgaatgcaaatgccaggtggggagctggatacaggaagaggcctaggctagggacagattcagatgtcatcagaaagtagatggggtttaaaaccactggactgaatgagatacttagggagagttacagacagaaaaaagaaggggctctgggacaagcctgggggcataataacactcatcgtgaagtcacagaagagaagccaacagagatagacaaagggcaagagtggcaaaggcggctgaaaggtccggcgaattaggacacagccgacagagtcagcaacacagaaaccactggcgacctgtcctactagtggtgaaaagtgtcacttctggatccagcaactgggaggggacatggtgagtcaactcccagagtgggcatgattcagagtgaggggttgctgggcaatgcggccttgggccttgggtgccagcccccatggaggaccaggtgacttccatgagtacaggctgccagcttcagggccaccgccatgctacaccccgcagctgctcccacgccacctgcagaaggcagtacctttccatcctctctgttccacttctaccactgcagagggaaggaaggaaaacaccatctcctctcacttcctgaccttcctcctctgcctccaagagcctttttttggtttgtttgtcctatgcacgactttttcagttttccaacaatcactggtgtcctatacttcttaaccctccacttgtaaaacaacacctttcagacactcctcagctacttttcttgcaaagaaacttgctgtcagtaaagacaagagagtaaatggagagaaacggataaccacctgctgatgtctacttgtgctgcattcttgagaaactcacaaaactgaaggcaatccaggtcctcaagaggtttacgaaccagttggtgaaaccacctagcacatgacgcagagaccagcgtggtgccaaacagtgtgacacccgtgtggggcagagatgccgtgtgtgggtacagcagctggagagacagttctggaaaaccagggatatgtcactagagcataaaagatggacaggaaatatgctcttccttaaagtctgattaaaaaataaaagatactttccaacagggccccgtgcccatctcagcaacgcagggcgtgtgtaaccaaatcacacagaaatgagcacttaaaatgacatctgttggattaattagctgtgtaattagtctcccctcagcggagctgggctttgtggctgttgtctgaaatctccccaggtgacttgattccaaatgccacactccaagaggaagaaagcacaggccaggaaaagaagacaggcgtccgaatgtgtttgcgggaggcagcgggaagggagagggagtttctggagaatttggtgggtccctcgggaagctagctagaacatcagggaggaatagccatccacagaggtgtcactcgagaactcaccacctcagagcaaatcggcacgcccccaaggcatgagttttggataaccccaaagcactaaacactcagagacatgaattagggcggcaagaccctggaggtgaagagagccgagtatggattccgagttggacacaaagagacgggacagaggtcagagctcttgtccctggaggagttgtttggtcttcctccgctgacagctgcagccatcactaatgtgaacccagtctgggcaaaaaaaaattaataatgaaaatggtcagagcctaatctgagaaccagaaagtgaacaaccacgcacaaacagaagtctccagccaaatcactccccacagtgcttcctcaagcacagctggcttcggagtcacacttgctgactcatgtctaggacacatagccctgggacccgcgccacttggcctggctcactagaggagccgaggaatattccccatgcttctctatctataattattttagaaaacaagagacatggcggtagaggggaagtatagaagacaaaggcacaggagctatgggaggaccacagtgaaaaccatcttggagcaggggactcctcagctggggacgagccagtggggttacctttgatctcccccacccccatctcgaggcacagagtaccctccacagagcaaaaacatccgatgctgctcagagaaccttcctgggcctgcgacaatgagcagttcgtaaagaatctggaacatgaaacattcaaatcaaacaagccctgttcgaaaccagcaagacatgttctaaagctagatggagccactctgctaagacactccctgccataaacacaatcggagctcctcccagatcttcagtagcgccaacaggcatctgcaggaccactgcagtgacacagactcgctcccaagggcaaaaggggtctgggagcaaacaccaaaccccgacattatcattctcattgtcccgaaggcccatagatacaggctgggtgcagtggctcaggcctgtaatcccagcactttgggaggcccaagtgggcggatcacttgaggtcaggagttcgagaccagcctggccaacacggtgaaaccctgtctctactaaaaacacaaaaattagccgggtatggtggcaggcgcctgtaatcccagctacttgggaggctgaggcaggagaatcacttgaacccgggaggcagaggttgtgtgcagtgctgtgatcatggctcactgcagccttgacctcctcggctcaagcaatcctcccaccgcagccctctcatgtagctgggactataagcaccaccacaccctgataatttttttattttttgtagagatgaggtctggctatgttgcccaggctggtcttgaactctcaggctcagctgatcctcccacctcagtccccactgcagctaggaccagaggtgtgtgccgccacacctggctaattttttaaatttttttatagagacagggtctgtttatgttgcccaggctggtcttgaactcccgggctcaagtggttctcctgcctcagcctccctgtgttgagtttacaggtgtgagccatggccccaaacaagttttttagtaacacattacacattcgtgagcctgagtctgtacaaaatcctacttcaatggccagcacaaaatcagtactccacaaatgttgttgacccagggaacgaagaccccttcccagtgatttcagtctcccagaagctgcacagggaaatctgggaaatcctgtgcctcttgggtcctgagggctggggtctgaacccatgggaggagaagaagtcagggtagccaatgcaaggatgccttccacccagaacccagacttctgtctcattctgaggggcagcaggaagacacggatgccccggtgtgacacgtgccaccaagaaaactccacagaggtcagctcagaaggggttagaaaggtccagtcatcctccaggaagagcatactgccagcgacagaagacaggaagagagactcaaaaggaacagcaggtgggtgtaaaccccttcagcaaccccagtgcacaggccggccctgccaaggcaatgtgggtatcactgttgacctaagagactggctatgctttggaggctctcatcctgagtccgggaacatgctccactcattaacaggttacaaaccaaacactatcagtagataaacatttctaaccttctaactagtttgccttttacagaaccaggagggggaccctagagaacatctcctaatcattcttgatgattagtcccaatttaaacctactctctgcattccctattagcgacctatacaccataggcacacagggtctcccacgcactgtgagcaatgctcacgtgctgtgaattttcatggtctacatataagtaaccagtgcaggaggagaccaagaaggcctggagtgaaccaggggcagcttcaacatctggccaagttgctggtgaccgaaccaggcctcctgatgtccactgtgtgacgcaaaggcatttcaataaaagggactcatgaaaaaaatgactgaaaagtaagtttgaacaaacagctctagagaaaatttcagatttctttataggaaagcattttacttaacacacaaaatgtgaatattggataggacacttttctataaataacaaaaactggatatcatcattagaggcatttgtaaatttcttttgttgggaaccactggaagaaaacgggtttcacaaacaaggaagccacatagctctctttacacttctatagagcctgctggcaggtcattatgaacaaatttctaggctatccagaggtagagctgctaaacaaaacacgggatgcccagttaaatgtgaatttcaggtaagtgtaagtataatttatgagatacacttacacaaaacatcattgttgcttatctgaaatttacgtttggaggccaaggtaggaggaccacttgagcccaggagtttgagaccagcctgggcaacatagtgagaccctgtttctatttttttttaatgtcatataaatttctttttatacaaagaaaaagaatgaaattcacatcactgagaattccacagttttctttgctgtatttgccaacaccatcccaagtcaccaccctaatgttgctagtttctacagtcgccagtatttctatgagtgacagattttctgccattagaaaattttaactttcattctacatcccggctgctgtaagtgctaaaaatcaatttctgttaagtattaaatatatacttactcaatactaccgaaatggttttcatagtaacagcctttcccaccctacacttactagtatttacagtttcaactgatgtgtaaaacagaataaagtacatggttcaggtggatcatataattatttaaaaactcttgccttttcctgactatgttcctgacaatgcctaattgttcccttatgatttccctttcaaaacaaaaaaaccagaaacacctgttgggactagacgtattcaaatctgccctttgagtccaagtcctcagcaagttgaaagaattcaacattgagttcacacctttgccccattatgtggcacctgccatattggctttcctgccagagtgtgtttacctaaaacaaccgtaacacaacgcattatcctggaatgcagaagcaacggaatatttgcacaaaattctcctaagggttacagaccacccctaagacggcagatgtcatttatgcgaagaattccacggtgtgacttattcctctggatgggtggggggtaggtgaaggtactggaagtttgaggtttctctctcataagaaggtccagggctttctaaatagagaatcggggggattcgtaaatattttgacaaagtggtagctattagactttctgaaattagacctccttgctgctcagcctaagtcaggggccatggtatacctttggaatccaaaaggagacttgtaaccagtacctgaaaacagtttatactggaaatatgtcgacagagtcatgaaatttatatgctatttacgtaagaacttcaggaaagggaatttccatggctttcagaatttgttcctgaccccttttttaagataaatggtgagatccacagtctccattaaggtgccctaaaaacccagctcctctttgcagactctgtttcttctggaaactctctcatcctggagagttcaatgaaggcaaactaatctaagaaattttcttttggggaacatgccagagagaaataggaaaaggtgagaggaaggcgtttggtccacagactccaaatgccaggaaagagagccaggcctttccatcccttcttcttgttccccagtgtctccgaagacagtattccgtaaatatgttctgatttacctaaatctgtggatcattcacaagaggttctgcaagacgtaagagaatggagaatgagaaacagcttttcacaccagctaggaaaggctggttatttaagcaatcgttgtacagctagccattgaatttgaaggaaaataaagagtcctaaatcacactgcatagtcttacaactatacaaaaaatatattcctgaaaagtcacaaatagggccaggcgtgggggctcacacctgtaatctcggcactctaggaggccaaggtgggtggatcacccaagttcaggagtttgagaccagcctggccaccatggcaaaaccccatctctactaaaagtacaaaaattagcgggtgtggtagtgggcacctgtaattccagctactcaggagggtgaggcatgagaatcacttgaacccagaggcggaggttgcaatgagctgagatcacgccactgcactccagcctgggtgacagagtgagacccagtctcaaaaaaacagaaaacaaaaacaaaaaactgcatgacaaaaaatgttcccccatctacattagaacaatgaaaagggacttactttagaacaatgttgtcaatctgacaatgaaaatggaaaaacaacaacacggtgttggtcactgtgtgggagtctggccgtcacttactggggaaggatgacatggccacctgctttctgaaaggccactgggaagtgctgcatctactggcattaggtcctgggacccaacaaccccacttcatggtgtgtgtagagaatcatgttcctagctcattatctgcagtatccaaaccctgcacataacctcaaggtacatcaaaaaggagctggttaataaaggaaatactatgtcgacattaaaaagagtatctacatgtactgacctaaaatgattttcataaaaagtatctatatgtactgacctaaaagtatctatatctactgacctaaaagattttcctgaataaaacaaactgacactttgggaggccgaggtgggtggatcgtgcttgagcccaggggttcaagaccagcctaggcaaaatgtcgaaatcctgtctctatgaagaatacaaaaaattagctgggtgtggtggtgtgcacctgtggtcccagcaacttgggaggctgaggtgggagaatcacttgagcctgggaggcagacgttgcagccagccgagatcacgccactgcactcccatgtgagcgacagagtgagaccctgtctcaaaaaacaaaataaagcaaaattgaaaccacagcatgtgtctataaagatttttaaaaatgaacagtatgtgtgtgtgtacagatacatacacacatgcattttcatctacagaagcacagaaaagagcacaaaatatcaactacatgtaacagtgggtttgcctctggacagtaaagtcagaaagtagacaaaagacatccactttaaaaatcattggaaaatacttaaagatgtaaaaaaggtctcaggtattacacaacgtcattccaattttgtaaaattcctatgttacatgcaaaaataaaaatccatcacatggtaggattaaccagatatatttactttcttttttattcctggatttttccaaatttttttacagtgaacatgcattactcatattactttaactgtaaaaaatagggaatccacattttattactagcttacacttgaggtaaacatggaatgctaaccttttaagaaataattaagaatacaatactattctaaaagggtctggtcagttctttactatccacaaaaaggactcagaaaagagagagagaaaaaaaacactaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggacgaatgtggatgaagataggtgggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccacggaaatgaaccgcaggcctccagctgctccaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagccaagctgggaaggcaggacgggagggaggaaggggacggtccccaaaggatgtatgctttttgctctcagtgcaagacaaaggcctccaggcaccacctacggacgtaaaatgtgtagctatcttcctaagacccccacttccccccagcacacccacagaggagcaccaagaatgcagatttcaaaccagatcattgtctgacttcacctacattttctgatttgcccgtctaccatacgatgattttatagccctgctgggagtgtgaatcccaatgagtttcttatgcatcagggaaagaactgaaaagatgggttctaaagcaatgcaaagtctgatggaagttttcttacattcttccgtactgcacaatcctcctagaatggcaggagcagacatcctctatgtggagaatctggccatgtgcatgaatcaataccacactctgcctcctacctcaggccaagcagagttggcttggacactggcttctcctctcctgtgtgccctgttggcccacagcagctcacatgtggcccagactcaacaccgtggtagacaaccctccttgtacagtatttaagattaacaggtaaccttcagtcttggtccaatcaaaggaaccccagctagaaaccgttttgagtaacagattctggtagggtcttaatctatctgctaaagttgacagatttccactccaatgactctcaggtgaagaaaaacatcaaagtgaaaaacagattctgggagatggtgggagtgtgcactgatttccaactgccctttctgtgccccgccccctccgggtagaaagcagcacacatttcagagagctcaccatggacgtcacttggctgggaatgcaagataaacgtggaagagctggtgccagctctgaacccacacgcctcagacgcaggctgtacactagccgtgggagagggcagagggcaagcatgtgtcagtgacagccgctctcctagttctgaggatcaagggcacccacatctctacgggtggagaagattgagagtggggccagggtgtagtcctctgagaaaggagtgatacatttacatgtgaaagcagaaggatgaggaattaaggaccccggagctcagtcccagttgagagacaagtgccttctgcatttttccatgctggctcagatgtgacactaaggacagaaagagcccagttcccaagcttcactggagcctctgggcttcttgctatgtcagccaatcacggggatcccaagacggtaaatgttaggacgtggacatgtgagcattaggggctaggccagagccggccactgtttcaacccaaaagatcccaaggatttcaatcaggagcactttgcagaagtaacctgaggcccagagacaaggtaagggggcttcccccggatgcctcgggccctgcggcattcccctactccactctacttccaggaggtgcaaaagaaaaacaggttgaacctaatcctgatttaaacattagtatcacacaaaaatcaaaacgacaccattccaggcaacgaagacaatatcatcaggttttgtagattagcacaaccctctctcatttctggattaaaaattatctcacgctttcagaaagttcactcttacagcaatctacgcactagcatgcgtgacagcaagggcagtgactccggcccagggtgaggtcagatgacacaccgaaagccatgccactgcttgaatctcctgagaatgcagctctgtctcctccaacatgaaaaaggaacaggaggagaataaaagcctcggctgaaagagaggtctgggagggccaccgggaagccacatacatcactgccacttcactaggtgccgcggagagcagctttggagagccgccctggctgatcatgaataatttgccagggaaccgggacagggtggggtggggaaggggtgaggaaggagggttgtgtgtgagaagcccggtcagctccccgggtcagctgcatctggagcggtttctctagcagacagtaaagaactcgattacatccagttaactgtgctctaaactgattatgcatgtgccgggctaatggattacattagcaagaggaaaaataacatgcaatcaatctccatttactacaggccacaccagggcctagagaaaaagtgactctcaaaccacctccaatccccaccccaaatccgtggaatgacgaaaccttgagagggagccttccttagtggcaagagaagtttgatcttagtcgtactgagggaccaaagggctgagggcgagcactggaatgacaatcccagcggtgtcatccaggagtgagcgggagagctccccgccccctgtggcgaagcccgggcaggcacagggccattcattacccaaggactaatgagactagactaatgacctttggctcctgacggaggcaattctgccctgaacctcaggctggtcactccggggatgtgccggccagatgcaccatttcaggatctctccttcaggtgctgggtccacgttctaccctgcatcccaacgctcaggacccttctacccacgccatctttttgagcaacagtttcctctaccttaaaaaaagaaatgagaaaaaagtcccaggatgacaggccagcagtgcagaaacatgcaaataaacctcgtctcttccaaccacacctcaccctgactctctgggtgtgatccgtggacacagtttggggaccaaaacaggatgttctcagcaaatccgccgagttccaggcccgtaagaagcaaagtcaagtgcctgacagactcttattcaagactccagccgcacggaggatgcagcatgagagttaatcgccaccgtgtgcattttagagtctaaagggcaattttttccttggatgcaagaggccagcttcatgccacctctaaacgaccttcatcaaagttgcatgcaaccttcaatggccacgccgagtcctttgtacaaattttactcagttgggtcctttggaaattcttttttccactggtttttccatcaggttttcttgaccacgtcggcaccatcctgtggccagttcagacctccaatttaaactgactgcaaagggcttttttcttttaatggtggcaaaactaagccagtccagcaaggttcttgctcatttgagataaggggattggatgcgtggtgtccagaccttcctcactgcaccatagctgagtccacagtcagttccagaacattctatcccctctacctcattcctgctttctcctcctttccctaaagtgctttcttaagcactacgttatgcaggcctccccacatcctgagaaggaacaactataaaatgaagtacaattatcaaccccggcagaggccgacatgggcaaaggactagaagtcttccttatatggaatctccgtttaaaatcattctgagtagagtagggactcaactagctcggggccagcagaaaccaaacactcgtgggcccaaagacgcgagaaacagtgtgaaaggcaggaggagaggctgataatgggagtgaggaaaatgaaaagagagagcgagggagtggaaggtgtgtgggatcaggccagggagatttatggcgatttgtacctgattgttcatactaaagccattatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaaaggagaaatagaaaaaaaaaaaaaggaataaagagatggaaaaggagaacagaaagcctaaaggagagagggaaaccacaggagcagaggatgcaaaagagcccatgtaagaaagaaaagaaccaaccctagaggcgctgtcaacaaaacctgacccaaaattgggcacccagaaagagaaccttcagctagtcaagctactcactgaacctgtcacgtttccacctggtgacaaagtggacaccgccgactctcctctcaactccaggttcccaaccaacagccaagcaggccatgccagagactgtccgactcctccccagtgctccctaactccccggtgcgcaaccccctcctttcagaaagagcgcctgagccataaggagctgggccttaccttgtacaacttcaggctggcctcgtgcctggagttgaccgtgtgcagccgcagcttctccaggctgttggtgtagtagtcacaggcgttgcacttgaggtgcacggggttgccgatggccacacacttgagcctccactcgttggccttgccgccctccttgatgtgggccaccagctggtacttctgcacgtgcttgtctgtcttgcagtgcagctggaagttggccttgagctgggtgttgtagcggcagagcttgcactggtatgagtcccccatcaccgccttccactcgtcctccgacaggctgcgctccacgttcatgtgcaggcccagcatgtccaggttgtccgtcgtgaacttgttgcagacggcgcactggaagagcttcagcgacgggtcgttggtctggatgaagctctcgcccaggttcatcagctcctctgacaccagctgcccgcccccgagccgcatgtctagggggatctcaccgcccactgcagggaaggagagaaggagagagtcagacaccaggctcatggtcacggccacagctgaggcaccccccagccctccgccaccctcaactggggtccaaaaggagaagatgacatttcaagtgttgcaaagggctactggctggaaaacaagcaaacaaacaaacacagtcaacctgatgtgtttcaatctttcctgcggacattctgagatttctggcaggttttgtattttctttctttaggaaaagaacacctagaaaagttaggagccatagcctctttaatatttccttttctttttttttttcccgagatggagtcttgccctgttgcccaggctagagtgcagtggcacaatctcagctcacggcaacctctgcctcccgggttcaagcgattctcctgcctcagcctcccaagtagctgggattacaggcacccaccaccacggccagctaatttttgtcttttttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtcacagctgcaatcgtaacataccaagccttcatggggaaccagaattgggcccagaatgtatctgaggtggcagtgaccaacatgactttctgccaccttgagaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtggtgtctcacacccctaatccaagcactttaggaggccaaggcaggcagatcacctgagcttaggagctcaagaccagtctgagcaacatggtgtacaaaatatacaaaagaaactagccaggcatggtggcgtgtgcctgtagttccagtactcagggactgagatggaaggatggcttgagcctgagaggcagaggctgcagtgagctgagaccatgccactcagctcagccctggtgacagagcaggaccctgtctcaaaaacaaaacaaaacaaaaaaagacttggagagtaatccctctactcctcactgctgccctctggtcaatatccctcccgtcagtcaatgctgccaaccctcccatgtcttctcagtagggctacctgttctctttcctgatcctctgccctgggtgacatgtggggctaccctaggaccaatcaccttccctttatcactcagtcacctacctacagagatgcaccatagctgggatccccatcagggcaccacctccctaggacaggggtccagtcttatcctcgctggccctctacagagtgcacagacgcccaaatgtttgctgtgccagacaagagtgaaaaaagagcgggactgctgcacgttcaggaagtggattgagacaggcagtgagacacgaggctcagctccacgtctccacgaaagggccgggcgaagatctcttcctccctctcccaccctggtctttttcagtccatcactgccctgcataaaccgggtacaagctcacatttgctatggtaaattaatactgcaagggcttatttctaccaggagaatggcttaaaaagagcagccttccctccagttcctagaagcgtacggtcaagcagaaggctgggcactggcgtctagtttctctttcctaaacacacgtgcacttgagctattaggtctgccccaccccccaagtgaaatttaaacttgaccttttatgtgtggttgggctgaggttattttattttttacaactgattagaatccaagtcagtggctcatcagagaaaatatttttttcttttttttatgattttcttattgacgctacacaagtcacctcgagtgataagatcagtacaggttctgctaagcagaccagcagctgcgtttgaagctcacggacagtctagcaagccacagaaatcttttgcacatgcattccagaaggcttaggaagctttcggcttgttgtctgtcttcccatctcccctggtgagaggaaccataactatgtcattctttttaggataagaaagaaaaacagaaaggaaaaagaaaaaaaaaaaagcctaaaagctccatcccttaacggggacgaaggccaggcaacatccaggaaacatactcagtgttcagtcaaagcagaaactgcccggagggtaagacaaggagcaaacatatatttgtttctgatgccaaccacctgaagcatcaaatcgtctccactttttagatttcaccccggcacatcaacatcgctctaaagagaaattcagctgtcacttgctgatgcctgagtgaaaatgagaagtccttggaataagcagaggaacgaagtcccagtttccactttaagctctttttttttcaagagacaaggtctcattctgttgcccaggctggagtgggtcactgcagtctgggccaccaaggctcaagtgaaccacctgcctcagcctcccaagtagctgggactacaggtgcaccccactacgtctggctgatcttaaaacaaaaatgttttgtcgagatgttgcccagactggtctcaaactcccaggttcaagtgatccttggactcccacagtgttgggattacaggcatgagccaccatgcctggccagcattctaggctgttaaaatgaaatgcaaaggacagaagcagcagagtgctgaaatgagtgaggatgacaggcaagtgaaaactcccttcgagaactatgcctcagagaaacaagcccagggcttagaatcctacaaatccgctaatccagctgccacaaagtgggggaatctcacccagttcacaaacaggagcagggcccctataaataagaaactggggctgggcatagtggctcacacctgtcatcccagcactttgggaggccaaggtgggcagatcacctgaggtcaggagttcaagaccagcctggccaatgtggtgaaatcctgtctctactgaacacacaaaaattagctaggcatggtggcgcatgcctgtaatcccagctactcggaaggcagaggcagaagaattgcttgaacccgggaggcaggggctgcagtgagccgagactgcgctattgcactccagcctgggcgacaagagtgaaactccatctcaaaaaaaagaaatgaaaaaaagaacttggcaggtccttagtcttgagccacactggatacgtggtcttggagcaggtccccatctctgggtatgcacctaactctaacactggaactgacaccttgacacgtgagcccacccatcagcacatcctcaggaaggtgcatggattcaaaggcacactctggaatgaaagggagacgaagggagctgctaaaccttgtgcaggtgtccaggggctggctggctacttgggaaacacacagccaccccgacaagcaacccctttcttggtgctatgctaaacttcagagtcgaaaggaaggtttgggaggatgttcacaaggcctcaaatctaatgtgctgtctacaaagagcagcagatccgactgtactaggcgaaggagccccaagcctttcctcaaaggcttctgaaaagaagcaaccccacaatcagtgtctgtttgatgatactaaagagggctctgccaagggaagtatgaaaacaatcaccttgtaaagaggagtgtatttcacaaaaacatttttctccctgcagaactcagtcacatctaataacacctacagccatcttataaatggaccatggggaaaaaaaaccagtacagccacagctagaactgaaagttatggctgtttttatttgcataagttggtttctcctactgaggtcatacaactcaaattccaagtcttttggacacttcctatggcccccacacccactcgagcttctggcataaaggatttgtggctctcacaccttctcagcagttttcgcggcccaaggaaggcacaggtttccagggactccccgtggccgacaagtagtgacactggaaattcaagagccctttgtgactgagctggataaatcctttgggaggaagagctccagtctaagaaatatggtgtggcccttccatgtgtgtctacaacacagggcttcattcttctgctccttctgaatctgccgcaatgcccaggacagtgcatgatgccccaaagactcacagacacttggtgtgaaagcgaaatatttctctacttctcaatacaagccttagttacctgttcttaaggtaattaaaaagcctcactttaggctgggcacagtggctcatgcctgtaatcccagcactttgggaggccaaggcgggcagatcacctgaggtcaagggtttgagaccagcctggccaagatggtgaagccccatctctactaaaaacacaaaattagccaggcatggtggcgggtgcctgtaatcccagctacttgggaggctctggcaggagaatcgcttgaacacaggaggtggatgttgcagtgagccgagacggcaccactcactccagcctgggtgacagagcgagactctgtctcaaaaaaaaaaaaaaaaaaaccctcactttgacccaacatgaacctacccacgttcccacgttctgtcttcattccacctccgttatgtttgatttgctccaagatctacctcccgagattctatgactccttctaattcctactggcttaaagaaaaccttagagtactcactcccatctcctggtgtgcatggttcaccctggtgacaaataagacgaccagtgcttgtgcatccacaattagccagttggtttcaaataccctcaaatcatttggtaataaaggatcaacaggcaaatatttcaaaatggaaaatgagattaaagtactaaggattaaaaactgaatacatagcaagaaaaaccaatggaatgctttgaaatataactcatcggcaacaattagcactcaaacaccacacaaataaacacttgccaactgctgaggcctggccctgcagtcatctaagccatcctggaaaaaaagtcctcactgacactctgttgccaagaacaacctattcccatgtcaataatggcatattgcttaattcaggccattgtcactggtcccacgaagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttggtcctattctagatattgtaagccaattggtaagactgggagcctgaacagagccaaatcagcttctctaaagcagaggtcattcttcctggcagcgaaggctccgctaaccaggatctaactgctattaaaagttaactttccttgatggacaatttttacaacttactcatttttcatctctcacacccctcacaacagtgccactggggaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaaatgattgcctcagctacagtttcctgtaagtttcagtaaatattcgatgaaaccccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagagtcaactgaatccacaggactatctcaccctattcaccattctccctggttaaactcctatcatgaaaacagacaaacacgtagtcatcctcacctagagcaggcgtcatggcggccatgggcccggcgggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgcggaggttcctggccacgttggtctcataatcacacacctcgcaccgccaggtgggtttggtttttggtttggtcggcgagggggccccgcaggagctactgatattggctgccgccgccgccgcagccaccgccgccgccgccgccccggcagtgtggctgaagacctgctccccccctccattctgcaggttctgcatgttgttgagatgcttgtcagactgcatatgaatactgaggttgcctttggtagttgtggagtagttacacacctcgcagcggaaaggcttgtaaccacacgtgtagctctcgcctcgtgccagccgggggtggggctgcccgcttttgcagtagacacaggagccccccggctccgggtgcttctccttcatgtgtgcctccagggtctgctggtacttatagtgccagttgcacttggggcacttgagtgtcttacacgagttacgagaatgcatcatggtcatgtggccgcccagcgagcgggaggagcccaggaccgtgtcgcatttggggcactccacgccactccccgaggggcactccccaaccccaagctcgcagagggagccagcgtgctggtgatggggaacgaagcccccatcgtcaccctctgtgctttcatttggttctggtgctgtggcattgtctttattggcactttcgtcagcgaagtccagcctcctgccgccctctgccacattggccctgacgccctcactgttaaagcttaaacgattcctcctgttcgcaccatcaaagacaacaaaggaagaagcagaattagaactagtagaagctgtgcccctcgacagggtctggagcacgttaggcattaagggggagttagaaatgctttggtttgagagagcaaggtcctttttgctgctactacctgctgcggccccaggctcctcatggggcctgtcctccagttcctcatccaactcgcttggaaagagtcctttgcaaccctcgtcttcctcctcctcttcttcctcctcctcttcttcctcctcctcctccgcctcttcctcctcctcttcctcctccgcctcctcttcggctggctctaccttctcagagaagcaatccccgtcgcccacttcctgcttctctccttctgccgccccagagtccttgccctctgaggatttggtaggactggaagccagaggccccagggggactgaggtaatgggggtcttcagtaccgagctggtgagcccgccaaggttcaacagggtgctgggggtcaagagaccagcctggggctgctcggggccagcggcggagcccgctgggagagcttcctccccttccattcgaatgccactaaatttaccataaaaactgtgtccggggcctatgaggttagctgtggaaactaaagggtgttgaaagtttttgttttttggttccagaaaacttacaaggggttccttgtctttgccgatcccttggatgatagcggagatgttcttattgctaagaattttccgctcgtcttcgctcagggtcattcgatggtcatgcaccgcgtgggtcacaaacgaacggacgtacccaaaggagagtttgcacaagaaacacatcaggatgggcttcctcttgccatagagcacaaagccatcgaatttggacaggtccacattgttgggaacatctttggatacgcaggagcttttggcagaaccgtcgctgttcaggtaatccttgttgcttttgtgtcgcacgtcaaacacgcggaagctgtgcaggacggggctgagccccgccagggctgaggtattcgggaaagcctggtctgggccctcaaaccatttcccgaaggatgaggctatgtggaaagtgttgatgatctgcgggtacacgggtgcagcacacgaagggtccccttgcttgccccccgcgccagggagagagttcaggaaaagcgaggggagaggcccactgccactgccactcccacaggcgcccccgccctgggtcagctggctcaggctctccacaatgtacgcggagccgtccggctggtagacgatctccccggccaggttctccacgtcactctcctcgtccccctcctcaccggtgtcgctggcgctctcctctctcaggggtggcggggggcgcgcgctggggcagtggtgctccatgtaggtctggaggctggcaaaggaggccgaacattcgttgcaggtgacctccttgctggcgggctcggaggggggcccggccgacgcggtgctctccgcgaggcgctcattgaagggggccctcaggctgtccaagggcccgtggctctcgcctgtggactgctccatgctactgggtttgtcagggaggtgggtgctgttgagttcagtccattgctggtgctgagggataccgcacccattgtccttccccgagacgacgggcgagtcacagccttccatggtaaggcctgcgtggagctttcattgcacccagtacggaggctcggacctgaagggcagaggcaaggggggaggagggagagaggggaaagagagagagaaaggaaagaggttaggagggccgaggctgaggtcctaccgcacggagcgctctaagaggcttctgtccacaacacagagacacagggcggagggcgggcctggggacactgccccacacggtccagcacacaggggtggcatggccgggtcaacagcctgagcgagggatatggggaaagaaggccaggaacagccctcttcggcttcgaattgtcaccgctctgcccctgaagactagcgggaatttccattctttgccagcatagcttcgatgggccacagtggagaacggacgcgtcatctctccagccctctacgaggtcacagccacagccctaccacttatggacagctcacacgaagtcagccccgactccgcgcactgtctgtgggtcaggggaacacaggggagggctgagaagagggaggttcaatgtccctggaaaaaggacggtaaagtgggataacgctcatggatttagaacaattgcagccgtcgcttttactgaccatggttctagtttgagaagttcaaagaaggcgggtgaggaccctgaggttcacagggcaggtgtacaggactagacacactccgaaaagtcctctccagatctgggaggcgtcagtcccattttacaagcagtaaaacagaggggcttcaatctaaaaactggctcagtgctaatctcaccaccatgaaacagaagaaaagatgggtccccagattcctgtctcctccacccataccagtcaagctccctggcctgtgactctagctgacttcagactaaaactacgtaggtgcaaaacgtgagcttggtatttccagcaggaatggaccagactctggatctgccaacaccccctccagcagcttctatctggccctggctggagggagtgcgttccccacgtgcctggtggtttttgctatcaaggatctgagcagcaagccgagacggcagctgggctcggcgagccccagctccacacctgcctcttagttattagtcgctacccaaccagctgtcgttcagccctggggcttttccatttccgactccaaagtgccactgagctgaatgtgccctctgagacctcatgtccctggggagggaggcatcggatcacggccgctctgctcctgcagtaatatcatcgcaggggcgatcattccgtctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctggatgacatctgattgatagcttgggccaaaaaggttggcaggcctgaaggggcgggagggttaacagcccgattgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttaccaattaattggtgggcttctcttgctccgttctcctcttattcctcctcctcttccacaaactatccagccaagaggctgggacttttaaaacctcccttactttgttttctactccaaagcggaagatgtcaggaaagaatgacactgtacccacctatgatggtggctggtgaccctgtggtggtgacactagagcccacccattcacggggagcagcagccatgaggacacgggtcggagaggaggaacccactgcaggacccaagctacctcccctgggcctcctttccatgcgcaccagctgtgacaaacaggcccgtttgcagccttgccaaacaagcgtggtttgtggacttgaagcattatcctctccggggagcttaagagacatgcactgtctcctcctgccccatcagaatctgcattttcacaccatcctcagggaccatgcattaaacttaagacactctctgcttcactccatcttcaccaatacaggtaccaagcacagctcttctgtccttggtacctgtattgctaggtaaccagggaaggtcagtcttagattccctgtggtccctgggaggtgcagggatggagatggagaagagggggacgcgcgcacagaggtaaagaagtctccccaatccgccacatcctgtggctcaagggtctcagggcatctaccactcccccgcaacagccggctctctctcgctctgtttatcagccagtcaataagaaaaaggtagttcttacttaaggaggcagaagtcaactcggcaggtcgatcagcactctgtctgtaaacacggtttcccgtaaaatcaatgatcttcagttacagagggcagcctgggaacccagtgggtccccgcacttttccaagcagccctgccagcctgacacgcacacctctcttcaggctccctccacgttctgtgccccttcccagtacttccctagtgccagggctagctggtacaggttcacacccctcctcccttcctgcagcccgcttctctgctggtggcacccggaactccctctaaaaaatgtccaggtattctgctcacaacccccaatgttgcactcaacatatgggcttcaagaattcagttagattttaatagagcacatctctccagtgagaaagttaaagggaagataggaatgacctagctggctcactgtctgcttagcacttaaatctgccatctgaaaggtaatcttgtacagaagaattccagcaccttcatcaagtatcccccaactcctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcagggaagctggggtgggaggggtgcagttatgacgaaggggagggggctcctgctgttgctccagctcccggagaatgaaacatgaacagtcgcactgtgtaattttaaattgttaattagcacagggttaattaggcagtcctttcacaagaggctgtctggtaggaaaccaagaagggaaacaaaggggaagggaggaaaaacaaagagagaatagaggcagtgagaaactgttgcctccaagaatatcccatgcgggatcactcaagagacatcagccagcaggcaaggatgcctgattccctgggtgatcccctgctctgccggagggagaagcagtgaataccgccttcctacaggcgaccaggcagcatacatcaaaggcctcagaagtgcacatccctccccgttgactcaacaattccccgttctaggaattcatcataaggaaagaacccaagcaatgcatggagatttaagtttattcatgaaaaacataacaggaaaaaagaggaaaaatttgggcaaaaacagaccctaaataaattacagtgcacagagctccatatgttgttataaagatgctttcttcaaagaaactatttataagcatgggaaaatgatcatacagatgctaaatgaacacagcacatataggtattatggagaggaaaacaggagagacttatattacaatttttacaactgtgaattctagggaatgaggtataggtgacttcatttcctcctatgtgcctttatttcccaaagctctttaaaattaaaaccatcattgagacagtaggattgctagagcccaggagttcaaggctgcagtgagctacgatcgggccactgcattccagcctgggtgacaaaatgagacttggtctatttaaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctgactgacaaaccggagagtatgggtgtggagtctatgctttcaggcagttttcctttgtcacccaggctggagtgcagtggtgcgatctcagctcactgcaacctctgcctcttgggctcaagcgattctcctgcctcaccctcctgagtagctgggcctacaggcgaccaccaccacgtctggctaactttttgtagttttagtatagatggggtttcaccatgttggccaggctggtctcaaactcctgagctcaggcaatctgcccgcctcggcctcccaaagtgctgggattacaggcgtgagccaccgcacctggcctgtttttctttaatgtctaattttcaaaagagaacactagaacatccctacatctcacattcacactcagtctttaagcacccagggactgtcctaaggtgatgggatcccaggactgctcatgcaaaagaacgctggcatctcacccaaacgcccttttcttgcttgagagtgatgggggtgaggggaacagttcaaagcagactgatttgcttggatatctttaggcagacaagagaggataaaggaggtaggagaagctgctgcaaagaactgaaatgtaggtccaatatcctgatttttaaagaaggacaaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaacacagaggtccgtgtgtctcgggacacgccaacaaggctctgtcttgtccctatttggctgactgaaatcaacagcttgaggaacaagaccatgcaggcatgtccacttgcagagcacaccagactcgagggaacaattaaaatgctcaacggtggaatcaagactgaggaaaaaaatctccatgagttggaacaacaggcccaaactaacagaacaaaactttagatggaaaaacatgaagccctacatttaacttcaggcaatctgctaaaccaatagaggatggaagagacttggagtcataagagttcatgcaaacaacaataacaaaatatctaggagttttacttgatgacaaactcagaggaagcccgaagttggcatggtggccaaagaccataatggggcctttggcaacagtactactctgtacctgttggagctcagcaggtccacagcccatcactttctctgtctgcgtgaataatgttaggaaccactccagggaatctcctaagagagataccaacaaagaagctgtagcctcatcggaatggctgaacacacacaccattcacgggtgcagggaagagaagtcccgttgcagggcaaggcagctatcctcggctatatgaaaccctgcctgccacaggcaagtgggtttggttctatgggttccacctagttccagggttgaattaggggcaatgaggggaatctataaggaaagagaggtggggtcactataaatgaaaatctttctcaagattatcacagttcccaaatggaatgtttatgctgtgaaatactgcactctgtggcttcaagaatggagaaggggattgtgctatggccagggggctgtatcaggcagcctatgaaaggtgaagattcttctcattcctgggtgttatctatgggcttgtctgtccccaccacaaggctatgagtggcatgagatcaggttccctgtgctattcatctctgagtcctccacatctgacatgtaataggtgcttaataaaacaatgggggaaataggaaaaaagaggatccctgaatccattccttttctttttttctcttagtttaagacgtgtctggtgtaaccattctccacaaaatggaactggggctccttggagacatggccaattcttgggctggagcaggaaaagttcaagatgagctcggagcatctacttgtgctcaaagaataaggaagatgtgtcaaaatgacctaggagtgggttggaggggctcccagtggccacatcagggacaacgtgagcaagaaaattaagtgacagtaagtgattgcaacccaatgtgtaacataacaatccccaagtccctactttaagaaaaaaaaaagtgtgggagaaaggaaagttcttccacagggtagaaactcaactaataaacgtagaaaaagagtatggagttagaaaatcaccatttgataaccatcatcatcttcatcatcatccactcagggaagaatcaatgggtacccaaactaatggatgaaagtttgaatacttccgggagcggtggctcacgcctgtaatcccagcactttgggaggccgaggcgggcagatcacgaggccaggtaatcgagaccatcctggctaacacggtgaaaccccgtctctactaaaaatacaaaaaaaaaaaaaaaaaattagccgggcgtggtggcgggcgcctgtagtcccagctactcaggaggctgaggcaggagaatggcgtgaacccgggagacacaacttgcagtgagccgagatcgtgccactgcactctatcctgggtgacagagagagaccccatctaaaaaaaaaaaaaaaagtttgaatactaacaggatatttacaatctcaaagtctctccccacaggatacttcttaattatagcaggaaaaaaaaaaacaacaacaataacttcactgtggagaacctggcagacaccaccttcattgagtgatcaaagttcccatcaccagcagtggggcaaacagacgtcatgtgcctcctggtaggatacaccgagaggaacacaacatcccttccctggtgttcctgtcaaaaacgcacaaccggaatctaatcatgagggaacatcaggcaaatccaactgaggacagtctgcagaatgtcctatgctttttagaaatgtcagggccatgcaacggaaagacagactgaagaactgtttcagattaaaagagactaaggagacatgactaatgaacgttatgcataatctgggatcttcttttcctctaaaggacataactgggacaactgacaaaatctgaataaggttttgtagatgggctaatagtggcatatgaatgttaatttccttttttttttttttttttgagacagagtctcgctctgtcgtccaggctggagtgcagtggcgcagtctcagctcactacaacctctgtcgcccaggttcaagcaattcttctgcctcagcctcctaagtagctggaactacagatgcccaccaccacgcctggctaattttttcatatttttaatagagacagggtttcaccacactggccaggctagtttcgaactcctgacctccagtgatccgcccacctcagcctgtcaaagtgctgagattacaggcatgagccactgtgcccagcctcatttcctaattctgataactgcagtgtggttataaaagagaatgtctttgttttttaaaatacacactggtatatttagaggtgaaggggcacaatgcctcgattttcaaatgggttaggaaaaaatatgtgagtgtgtaagtgtgtgtatgtgtatcagtatatacatacatacacatacacatatatacacacatatatatgtacctacatatatacagcaggaataaatatatgagatgttaccataggaggagtctagaaggaggacacgagaattctttgttctactgttaaaacttccctgtacacttgaaattgttaaaagaaaaagaaactgtccagagtaaaaattcgacatagtaaccccccaaaactataaacgaagagtcaacccaccctgacatgcgtatctttaatctttatgtgaaatttgctcccagcagagcttcaaaaaaggaagtggctgtgaggctggacagagaggtgtagagagacaaaaactgaaaactggtctccccttcctccagccaagaggcttctaggtggagccttccagttggagaagacaaataaatggccattccaacttgggcagaacttcacgtaatacaatactgagccgtttccccgtgacactcatgatcctgactgtgggctgatttccctagttccctagggaactttcgcaaagttccctaactttgtgaaaagtgattctaagtaaaaggacgagggcagcccccagagaaaaggagaactccagcagcccccagagtgtgagcattgttaaatccaggctaaaacatatcagagagaaaaacacactacactgaagcaactatcccctcactaaccccacctccttaaaaaaacaaaaacagaaaaacaaaggcaacccagattccaagagaaggtgaaacctccttcaagggtcaaagaaataatacctgcatctgtttagcttggaatccactgaagaaccatacccagttcccttctgtgtttttttacaataacagtgtttgtctactgctgctgcacagaagtcaatatgtgttaagccatacataggtgattccatctgcttggtagcaatttcccagcagccttcaggattgctctgcaagtgtggccaggtcggagaacacacaggtgcttgaacaggcgccttgtgctgccggacgcccactgcccagaaggcccagagaatcgcccaggccgtgggcctccatgtttgctaataagtgcatctgtgctatttccagcatgaacataaatcagcctagaagtgaaaactgctagctcagcccattctgcagggaatccacaaccaccatgatattctggttacagtggagtcgtggagggcaacaggagagagtcgtgacagcggaggcaggtctaggaacccagtctgtgtgtacttagaggaattaaaaaagattttttttttttttactatatatgtaaacatactcagagttcaaccaccatgaatcaaaaccaaacccatgaatataataataaaaagcaagacaaaccagctattatttatgctctgccttgttctaaaaagggatttggggcaatttaaacagctatagtaactgtatctcacacttgagtacgtaagtctctaccctgagtcacgtggaggcctttccaccatttccacaacaagaaagacaagcatcgtgtgcccatgactggcttgactggtgctcctgacttggatttaattaccatagagcacggatcccctcccggatttgcagcagaacctcctttcaccaaataccattgctttacctgactgtaccaacccacctctcctaccttgcaagcccgcagctcacaaccccaaccttcacccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaatgtaaaaacgtgccatctggcccattacagtttcaatctggcatgtcatgatgtcaaatttatgttaaatcatgtcttatgattaaagttgtgggagttcattattttaaaaatttggatatgtacaaaaagactcagcagctaaagttaaaatcactgacaattccaccagctagagaaccactggtaggtagtttttcgggcttttttcctctgcacgtttacagatacagattttccttacctacctcggatcacgctgctgtttatgtaggccgcccttttaacctaatttagtatgaaatttttcctatgccattcaatattcttcataagttaaaactaatggctatatagatactatatcttatacacattgcataatttccaccaaatgctattattagacatttaaacaattcccaatattttgctgttcattttgcaataagggcccttaaatctttgtacacatataacaacaacaacaaaaacaacaaaccaagtagtagctccattactgtccacctggttgaatcaagcatggttttgagcactatttttctgaacatgttgttttgtttgatccttgcggcagcccactttacaggtgaggaaactgaggcttagagagttaagtaccttgcccaagctgcatgctagtttagtcggcctttgaaagtaggtaagcctcccttaccactctaaaactaggctcttactcatgacgttgtgtctgtattgccttaggatgcatttctggaagtagagttgctgactcaaatgctaggaacatttaaggccctctggaacgtgccaaactgtcccccaggaaagtcctttccactcctgcttgcactggtgtgtgagcaccagttttcctgcaccctcatcaacagtgggtatttactttgttatttttaaaagtccgtttgacaggcaagaaatggcatctcattttaactcacattctttactcataagacagaacccatctatggatatttactggcagtctacatttcttttgtgaactgcctattaatttttttttttttttttttttttttgagacggagtttcaccctgctgcccaggttggagtacaatggggcgatctcagctcactgcaacctccacctcctgcattcaagcgattctcctgcctcagcctcccaagcaactgggattacaggtgcaggtgtgcaccatcacggccggctaattttttgtagttttagtagagtcagggtttcaccatgttggccaggctggtcttgaactcctgacctcaggtgatccacccacctcggccacctaaagtgctgggattacaggtgtgagcattcatgcccggccttgcctgttatttctatggcaggtgtgtgttgtccttttctgagtgagtaatgaaagggttttgcagaatttgactggtgatccctcccccttgagttcctaccagtccaccatcctataagctcctggacaggagagagtctgacctacttacactgccagttcagaagatgttctctgtccttcagatctcaactccatccaaagagtggactctgtccactgcttcatttgctccacatcaattttcctgtattcaagtgaagtccccctcctttatgtgattataaagggccaaactgcatcaatcattttcaagctttcttgtgcagtggaaccaactatgcggcacaataaaaatacatatggatgtcaagccccagcccagagcacaagactagctctctgaagggctgggtatctgctccgggagggtgggaaggcactatgtcgccaagatttctgtcctctgtccaaagtcatcggtgtcctcctggtcttggtcaatggttcctcctcctctactttaagcttcaatctcccctgcattcaaaactgcttccccctctactccttgaaatcttcccccacttcacttctgacatattctggccctcctcccacctctgtcatctctacattgcctgtcctctccccattcctacagctctccatgggtacattttccacttattcgataaaattcttttatcatttcaactcacagacatctctcctccctgttctcctgtaggtatttaagcgtcattgtactcttcccccttggctctctgctcttaactctgtacatcagctaccttaactacttctgcggtttcaattactgaaattacgagctgactcccaaagcaaaaatgtccattcctgacttggcacttgaatatgtgtctcatactttcagaagaccagaagatgtctgtacatgcctagtgtcccaccaaccaagactcagcatggctcaacatgtccaaaggacactgccccctcactgtcggccctggtctctctggaaggaacttttggtgccatctttgcagaaaacagaaaggaaagatcagtctggctttcccaatatcatgttcatccccatccttccccatccaagaaacaactaccaaaacacattcaaactgaaactctccagagcggtttcaaatcaccccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtctactatggttcctaagttcctattaggtagctcttagtcagcagaacactaattggaacagaagtaagtgctatcattcaaggctgcacaaacccaagagaaatgaacttggtcagattctttgcacttggcagtttggggaatgcaggcagaagcagccaggagccttaagttttcttttattcacatcgaatctacctgagaacaaatgaagaacatggtacagctgcttttctctgggcctgtggcagctaattagagcacctgggaaacaccattcaacgttgctggacagaggtacgtcctcgcaatgattccgccaaatggcacacacaggacaatggggaaaacctgtaagggtgaggtgagagctggccttgggcgaaggaaagtttcccacagcagttatctccaaaatgactctgaaacaaggagtgtgttttcctctcggcaggaagaaaaccactcggtgggctcaccatcggcagcttgctctggcacgaggctccggaactggcaccatgacaaaacaaacaaggattgccctttggaggctcactgatagggcaacacacacacacacacacacacacacacacacacagcctctcaccaacacgggcacagcgagttcttcagatatccctggcctgctggcataaagagcttttcaagcagtgggaagccaaagggacactcaacaaagcagtaatggccactgtaaggtagagacattggtaaaggcatgaaaaggggatgcctactgcaaaagcaaaatcgtacacggggtcttccccatgccttgactgggcaccctcgagagacccctttgggatgtgcgtactaagcttccacccaacttcctatctggtggaggcatgctatgcacagagaccccatcactgaattccctcctagataactcactgcactagactgaaggcttgagaggtttatttcatcatgagtagtcctcaaatcctagaggcccagagagttgctcctatctcgattctctttcttagggtaaagtgaaccggcagcaagaactaccaccaggacgcaagggctttgagacagactgaagggggcatggattctgctggcactctgagtttgtttgaaagacttccaaattccaaagcttaaaaccctatcagggccaggtgtggtggctcatacctgtaatcccagcactttgggaggccgaggtgggcggatcactggaggtcaggagttcaagacaagcctggccaacatagtgaaacaccctctatactaaaaatacaaaacttagccgggcatggtggcaggcgcctgtgatcccagctaactcaggaggctgaggcagcagaatcacttgaacccgggaggcagaagttgcagtgagctgatcgtgccactgcactccagtctggaagacagagtgagactctgtctcaaacaaaataaaatacaatacaatcaggagagaggggtgtacagggggaagagaggggatcatgaaacgtgatcacatgtccccttcttcatggccccttctccatcccacatggtaattacaaagcccattatttgcactgttacttttaatcaagaaatccatattgagacatacttaccactggccacttcaaagagcggccctgatagttagctaaaataacaaaggaaaatttcttcttgaagtgtaaggatccaagagctcacacttccttaaccttccagaagccacccagagaaccaagtgactgtgggcaataattacaccctcaccaactcagcaaaaatggcacagatggtctttctcctcttgctgctcccaatgctgcgtttgggtcaacagctgctaagaagaaccaccaaggccacgttaaatagtacttggattaattatgcttgaaaatctcttatctgagcactgctaagacagaacaattgagtttgggaatgagtgtggttacatatttttccttaatggcttcctgaacaccctggttaggtctggtcccaggggagaaattgccagctcaagtcataaaatgtgatcaatgtagatcaagaccctgtgctaagtgtctaggatgaaagaggggaagcgtatttgtgcaaacacacaaacatatgaaaaatgcatgttaacataaagaacttcagctttctttctgaagctgcaccctctctcctttcatgcctagagctctgctcattccaccaaaacttccagccagcagttctaatcttggacagcgccagaacaaattttggcaactgttcctgcagttccaaaagattcccatgttaagccatggtaagattcggggaatcaaatctggatggtgaatggggccaatttctttgacttcaataacacagaggctactggggttccagccccagtggtcatagttttaagctcctctgcataatacttatccaactactcactggttgttctaatgatttttattcattcgtgccacaatatttattgagtgcctacaacatacacagcgcgtccctcctgtcgatacagactcctacgagcttgctctcagtagcgtccaggcaggcaaaggaaggaactggaaggcagtgatcaggaccccggtagaaatggactcagcactccacgtggccactgggattcactatgtcaacacaattatctgggttactgctcgcctcattccagagtctacctgctctgatgccagaatctgtccttctattaacaaggtgtggtcacagtgaactgactgaggtccactgtgtttaaaaacactgaccatggcatctcatggctggacaagtggcaccgccgccctgagaccctgcagtgctggggaacccggaggccctgagacctcggttcaactccgccagtgccccgggagttctaacccccacgggggtctcgccttcagtccacatgggagtcacccatcaaaggcattttagggatattttaggttgaccatttcctgacagcccaacatgtttttctctgggatgaagggcatgccatcccacaaatggtgatgagaaattgcagaaccactgaaccggcctacacataagcatttcttctcctttgatgtcgagttgacaagaaaggatatgatttcatttctactggctcctcttaggtaacccaactggtttcccacttcctcacctgccctttgcattcccatcctggtttctttggccttggttcctctttaagctgggaccagcgactttataaactccacacacagtgcagcaggttccagacgcagcgtctggcctccccaggtcttatgaagaggtgctgagggttggcgggttgacacactcactgcactgcacaaggaggtggctcagcccagctttcacgtgaccagtgtccatttatagggtcgcatgctcacgacacatgctgcattatggggaatgctgcagagaggggagtcttattcttaaaggagttagaattgaagcataaagtctaggaactaacatgaaccacctcttagaagtctatgtacaacctgcactcgactttgagttgttccccaactattagttccctgtcgtgggtcagtggggggaaaaaaatcactctccacacagctcttgaggagaggctgggatctctacgattcacttggtgtctacctgcaggggactcagggaaaaaaaaagcaaaagccacaccagcatgagcatatcacacagaaattctactgaccccaaaagcggggcaatgaaaatctgtgcacaatttcaaaccatgcaccccagggtggaggggagagatggaattcaggggaagtgagaagaaaaaggggaagaagaaaaggaccagggattttttttcttttttcttttttttttgagacagagtctcactcttgttgcccaggctggagtgcagtggcacgatctcggctcactgcaacctccgcctcccaggttcaagcaactctcctgcctcagcctcctgagtagctgggaccacaggcgcacaccaccatgcccagctaatttttgtatttttagtagaaacggggtttcaccatgttggccaggatggtctcaaactcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgttaattgtgggtttttatttttatttcctattaccctctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaaggggaggccactatacaacagttgtaaagatgtcctccagccagtcatagagatgatcctgaaggcacttaccatttattgagtgcctactatgtgccaggcactgtgctaggtgcttaccatgcccagactctggtcctcacctaaccctctaggacagatgttcttctccctctctctcctggatagatgaagaggcagaggtctaggaaggtaaaggagagaaccagttggtaccaacaccttcctgagggtcaggccaaactctcacaagcagcaaaggaaagctgagtgtcaacaggagagctcacacctgagtcctaagagagcgtggagcacatgtgatgggctactttactcttttacagatgtagcagatgatagattgtgactaatccacctccatcatcctcagcacccaacaacagcgctcctgtgtccaaggctggaaccacaggtgggcttctcttcggaatacgcagaatggttactgttttagcagttaagatccctccaactgtttgcctgccaaatattgctttgcttacctaaggcctatggaaaaaacagcaaggagctcctcaaaaagacaagttctatgaaaaacaccaccagccaggtggctctccagacctccacaggccatttcgccataggaaagatggatcacagaagaaccagggcacagtccgaaattaacactgctccccacaactcttcactgttaaaatggaaattttacatggaccagtgatggcaatgtgtccaaccaaaatctctcaggaagcttttattgagtacctaatctgtgcctcaacaaagcaaagaatatataagacatggaccccgaaatcaatgcgcttacagactaggtgatggccccataagaatacctagcacacagttatttattgatcctgtttacaatatacaatacaacatcatagcataaattgaggcccgggcaaaagaagaaagaaaaaacaaaactggaggaaattttgaaccaaaaaaatcaagcttaaaatgcatgtaagaataacctacacactgagtcaaatttggctctaagctttctaaaagtcaagaggataaaggcatgctaggtatgcttttaaaggtacactatttacaatgtccaagagaaaaaaaaatcaattggtcaggattatttagctccagtaatttctcaactgctgagaatgggataagactaggtgcaagtagggcgtgcagccctatttcccggatctctttgtggaggtaataatgagaaggcttgagtgtgaggccagctagtctcactgtttccactgatagacaagaatactgaccccacagggtgttggtggtttgctgacgtcagagagccggtcagtggcagagctaggacgaagacctgggtatcttcacaccacactaacagtgccttcctcccacatgaagctactccgcatcatccttttaaatccacaggctggctggatgggtaggggctcacatggacgttggggaaggaggagaactgttctagattaaaggggacctaagaaccaaacaacagctagatgcgctatgtagtttcgtatggatgccagttctaaccagccaaatgtaaaaagccattttggggacaatcagataagtctgaattgcaacttgggattagatcatgttaataatgtcagttttggccaggggcagtggctcaaacctcaagtatcagcactttgggaggctgagacgggcagattgcttgagcccaggagtctgagaccagcccgggcaacaaggtgaaaccccatcactaccaaaagttaaaaaaaaaaaaacaaaaacagctgggtgcagtggtgtgcgcctgtagtcccagctacttgattgcttgagaccagggaggtcaaggctgcaatgagctgtgatcgcaccactgtactctagcttgggccacagagtgagaccttgtctcaaaaaaagtcagttttgttagggaataatattatgtttacataagaaaatgatgaagcagcatgatatcgttggcttcaaaatatttcagcaacggacaaaaaagacggaacaaatctagccaaaagttcattgttaagtcaaggtgatagaactatggaagggttcattatatcattctttctacttttatacagtaattttttttttccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctcctttcaaacaccaccatctactgacccccactcttactccttctcttagaaggtaccaagcaccaccaggctgctaatgtttaaaagaacacagaaaaagacaatatgcatcacgcctgggcatagcacctgacagcctttataagtggtagctatcacgatcattactgagcaaaaatgcgcctgtttacaaaagttaacagcctaaggttatataacagcttgatttcaagctttgagccaaagtctgattaagaagaatatacatccgttgaattaaaagcctccacttcttgactcaacgggttaagaaaatatttttaacactttcagtgagtttaaaaaatcagatgtttaccagccattgtttttgcgcacactgtcttttatctcagcatgaatgttttataagcaccttaattgctttgcaaagcctcaactgaactgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacattttcaaacactctcatttgacctctaacaatctttttaaatagaatgggaatcatattttcgattttacaggtttaaaaaaataattcattcaaacatctgagtgactcctacgagtcattctttctcaaggtcctgcaactggttagctgcagagcaaggaccaggacacaagctacagtttctactgtggtgctcttggctccatgaaggcatcatttccttaaagagaatcaccaactcacagagaaacaagaagaataaagacagaaacctacctgctgcatgcctaagcttccaaatccttccaaaacatgtatcatctaaatacgagaaaaagataggatgccaaagacccaaaggaggtattttcattgatcacacctcagtggagtagagttatacacaccaccaaatattgagttgctccacacagaccagaacagtgatggcaagacattaagtcgtaaatttttacataggccagaatggtggagggcccgagaaacaaatccactaaagcaccaagtgctgaagcaaggatctttggcccataaaaaagtttaagatctgaggagtagcctgggtgcaactcctcctcttagaccctagactgcaaagacaacactgtcatccaaagcagactgaccactcggctcaaaaggctatttgtaaaaagatgtaataagctgtcaacgtccaggagctcctcatgaaggaggctgaactcagaggagctcatgtcaacgcagagttcaggttaggaccagtgggggtaacgtaaagggtgatttgggccccaggattactgtagcatgacccaagcaaagtgcacatatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttcttagtccaactgactaagctgagtgacatttttaggaagagcattaatgcggaaaacaaacctttccaattcatggaatgaggtaatctgggcagaggaagggtgggggcagagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagcaacatagtaagacccccatctctacaaaaattaaaaaattagctgggagtggtggcacccacctgtagtcccagctactcaggaggatgagatagaaggatcgcttgagcccaggagttcgaggctgcagtgagctatgaacgtgcccctgcactccagcctgggtgacagatcaagatcttgtctcagaaaaaaaaaaagagagagagagagaaaggctgcttaagccattgctccatgcaactctccaaccacatgtcaaacaccattcctaccatctgtccttggagcccttccctcaccagcacaggtctaactacccactgccaagtgtgggtacagggtaaggccctgctcagtaagcctgtggtctgatactaaagtcatatcttgccattaccccccggccccaccagttatagtccagaaccttccatcttgctgttggctctctatggcctggcttcctgaccctgttttgcatgaacccttgaccagctggggcttaaatcccatgggtgggaatctcatacacctgcagccttcttgcctatacctgctcacgctccttcaagcacaggcctcagcccttatctgaataacctgtctgctggcttcctccccatctgatagtttcactcctggctcctctcaggcagcaaagaggaataagcaagccacaggctgcagcctggcaagacagtcaggaaggtggcagctgccctgattcaaccttcctcctagtctatctactgcctcttcctcctccattccccagtgactccatgaaacttgtgttcacaaacttgaaaaattcactggtgaggccaggtgcagtggctcatgcctataatcccagtactctgggaggctgaggtgggaggatcacttgagcccagaagtttgagaccagcctgggcaacacagtgcgacctcgtctctataaatccttaaaaattagccagacatggtggtgcacgcctgtgaatccagctacttgggaggctgaggtgtgaagatcacttgagctcaagaggttgaggctgcaaggagccacgatcacaccactccactcctgcctgggccaaagagcaagactctgactcaaaaaaaaaaaaaaaaattcactgaggagatgtggtagatggcttagaggtcaatgttataggtcaatgtcccttaggttgaacagcacctgtgttgctgggtctgcaatgttgaggaccccgtgatggtcttcaataaggctggggcgaaggggctaaacctcactatcgtgtgcaagctcaccccaggcctcaacagaatttatacatataaaatttatatgcattacatgtttacatatgtatgtatacatgtacatgtatatagtatacatatggatatatttatataaatatgcatatatacctatacacatatacacatacatctctcatatttaaaacaaaatagagcaattaaaagaggaaaaaaacaaagccaacacacacgtacccctaccaccaccactacgaacaccaacacgcccccacaggcaagatcttgtcccaagtttctgagaaacgtcacttaatactacgtaatctcgaaatgatggggtctgcctactggctttgtctggagactggactccagctgctctcctaaactgtccttgtcaccttctcatcaggagaaaaggggaacgtaaacatgaaccacaccagagatgggctatccagtgaggctgatatcatctcaggcgccaccgacatctctctccagcattctgtcatcttatgatcaactatgtaactccagacatccaggggaacctgaatcctagaactagatgtccccaaataagtggtttctctgtaaaagtcaaatgtggatcacaaaacaaatgtgaggggagtcccaggaaagccagttgcataagggtgtcctcaattaaattctacacacgtcaatttttccccagggagggcgaggcagagctgagaacaacattggactggacagactcaaggcagggaagaaatggaattttcgctcttgagattcaaattcctgagtcatagttgaaatcccactgctataattgttttaatacactgtctccacacacacaaaaagacgcctttaaaaagttgtactggcttccagattccctggttaaaaccctcccttctcctggacgctctcagatacaagctgtgttgaactcactagcagctgtcacattctggcacttgcttgggctgtgaccagagcagtcttccgcccaaccagggaaggcacaggctctgccggcagagcaggggttaatggaagctgaccgcagcacagttgttaaggtaatcaataccactgagatactaaagcagtgtaagccacaatattgattgccaagcagatgataaaactgtttattatgataattgcagggtccctgcaagatgctcccagcgcttcctaaagctgtttacaaaactaataaagatttgccatttcaaggtcttccatttttaaccaccccccaccccgccaactccccacaatctcccactcccaaaaagcaggcctcacccctgggcggttaacatgttcttcccagggacaggcactccatggcccgtcctgggtggagcttcactctcagattctctaaagaacagactgtccttctccaccctcaccctgcccccaacttcaggaaggggaggacggaagcacagccgacagccactcagggccttcagatttcctccttaggacccgccatgtgataattatggggttttatcgatggaggggggctgctcagggctccttgggctgacatccatttgttctaacacatttaagaaaccacaccaccttggtttgtaattaaaacttctctggagaacttggtggccatgaagctaactgaacatggtcaaatgctgattgtagaatgcatttccgccaacactactcaactgtgacttgggctgctgaactgggcttgggtcccaagttctatcatgcccaaggcacccatttagtttttattagcagtggaaattaactccttcttggtcacagacaccaccgttttcctcgagacgcaagttattgaattatcggcaccgtctccaatgctgtcacctcatgttcaagaggaactgcaatgcagacatatttttcaatataagtaggcatctcgcaggtagtataatcatgttcttcggacctcttaggggaaagccactgggtcctgcgattaaggatggcagccccaggacttcagggctctgcaaatataccgaaggtgtgttttcagagtgtgaaatggaaaaaacatagaacccagccaggtgcagtggctcatacctgtaattccagaacttttggaggccgagtcagacagaccgcttgagcccaggagtttgagatcagcctgggtaacacgacgaaaacaaaaccccacctctacgaaaaacacaaaaattagcaaggtgtggtggcgagcacctgtagccccagttactcgggagactgaggtgggagaatcaccagagtccaggaggctgaggctgcagtgagttgtgggagctgtgatccagccactacacgccagcctgggcaacaaagtgagatcctgtctcaacacaaaacaaagaactcaagttttaaggagaattcagtagtcattccatcagcagctagaaggcaagcacccatccctcactcaactctcatagcagctaagaatattttacctgtaatagacttctacagcactaggccttcaaaacaacatttgcaattgaagggacaccactttgagagctgacaggccaaagtaagatgatgtggaggctgcttccacctcccaccctccccgatcaaagcatggagaaatcattcaccagtgctcctggtctccgttgccactgccacctcagtttaggtagagggacctctacctgccctattttcttcccattcagctgcaaccagcagctctgggaggtcattgcccccacactgtgcctgtgtacacatgtatgcttcaatggtgtggaccagtacagacatgcagctcctttatagacatctggttctgccccacctactcccaaacacacagaaatcagaacactggagccagttttatgtagagtatcattcgtttgccaaagaccttgccatgaactcatggataccacagcatggctggaagggatgcaccagggattcctttaacctggctacctgctcttagaggaactatttggcaaccaggaatggccggagggaatctgaggcttccctaggactgcctttcatgaatcacctgctcctaggcaaagtggcaaaggacagacaaacgccacctactgaactccaagctggacgccctattcattcacatatgctcacggggcccatgttaacaaacacctccctggatttgataccaaaagaaagtttaatattatatgtggctaattctgctgttaccttttaacctcacttgcacatatctgtcctcccaacaataacttcagcaaaaaacataccctaagaacaatatggtccacacttggaaacccgcccaacagggccagtcgagcctgcataagtgctaagaaccatttaggagcactgtaaaccattaaggccattagctctaatttgacctccacaaaatacatcaacccactaggaacaaatttagaagctttccaaagtcaagttctcaaaacctgaaaggctcataagcacagtctagggcagggaacagccagccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggaattcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaagcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactcttggcctgggcaagacagcaagacgctgtctcaaattaaaaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatactaggtaagtggacagtgcacatggataagtcaacaatccttcagttgcttcaatgacaaaaacataccacatacttatttcactcatctttccagggcagaaggaagaaataagtgggaagaatatgggccaaatgagttagcagtaacaggagaagcaagatgcagcacacagagttctacagcccaggaagaattgccaaaagctgagtaatccattccagctccaccctgcatgaatttccaggtatcaaattatatgttaattatgcggacgcagagttatatgtggggaagtggtgttagtcagcacccaaggggtggaaattcagtaaaaatttagttttgtcaagtatgtttcatgcacaggcctggggctcctctggctcaggaaaagagaaagcaggagtcaggaggcccagacctttccctaacagggtcccacagccaattcgctggccctctctagaccaactttcccgaattataaaataccacaaggtttgggtttttttccccccaccgtttctgttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaacgttatcagtctcacacatcgtgcccctgcctccaaggcccccatcaccacatactgatcttgccctgatttgaagcgggcgggagagagctatggggaagtccaggcctgtcccagccacggatgggacaaacagacaggaactgagtgctgaagaccttgctgtagctgctgagcgatcttaaaagggatccaccctggaggagctgagcaccctcttctttccagttctcctcactttaaacgatttttgtctaataatgtacccaacaggcagatatcagagaagcactaaactaacaccttgaaatgggtcaataatggctgggcgcagtggctcatgcctgtaatcccagtactctgagagtccgaggcaggtggatcactcgaggccaggacttcgagaccagcctgagcaacatggcgaaaccctgccactactaaaatacaaaaattagccgggtgtggcggcacatgcctgtaatcccagctactcgagaggctgaggtacaagaatcgcttaaactcgggaggcggaggttgcagtgaaccaagatcgcgtcactgcactccagcctgggtgacagagtgagaccctgtctcaaaaaataaaattaaaaaaaaaaaaagagagagaaatgggttaatgacaaagaagtcctatacacagcatagtatgtactgtatagcattaggataatatagtatagcagtcccttatccgaggcttcatcttccatgacctcagttacccacattacagtacagtaagatattctgagagagaggagagaccatattcccataactgtcattacaggatattgttttaattgttctattttattattagttatcactgttaatctcttactgtgcctaatttataaattaaattttatcataggcatgtaggtagagaaaaaaacatagtctacctagggtttgatactatcctccctctcagacattccactaagtgtcttggaatgtctccccaaggataaagagggactgctgtcgtggctaggagtatatgctctgagctggcatcccagcgcagaggccatttaacagcagcaaatttgctacagactttgggcctcaagttcatcactcatatgatgggtgtaggatcatctttaccccatagggttgtaaggattaatgagacagtgaagtatttagcacagtagatgcttaataggggttagctattaatgcttatattaatatttattaacatttatacagacaaagaacatgttctcatgtcatttgcatagcaatccaacaaaggccgtattctcacttttgaggctcagagaagcagagagacttgtccatggtcacacacaagtactcagacttccaggccagtgtcttttccatcatcttttttcagggtgtttcacccacgcaacactggccaggggctagatggttccaggtgggagtgggtgaactttgtacattctggtcattagccagtcaatgtttatctgagccaatccaaccagcacgagcctgtgattcctcagacacaattgctcgggatgatgctaaggtgggtatttgtggttataacggaggatcccgtgaaaagaaaaatgtaaagcaaataatacagtataggcagtacaaagaaacaacagaaatgatgccctgagttgggggcagaggggtctcttccactctcagaggctgtcgccgaactgatctttctcacatagtcaaccattaaaagtccccaacccacaggtcctagtttcttctaagtatccatctccctccttgctagagcagagcctccaaaatgaaagcgtttctccgccttcctccaggcctcctgagaaaggttatgagatgggttatcagcctctctgacctctgcagccatcaacagcacttctgcctctcccatcccccacagcgaggatcctacagcccagagccagcttccctgccttcccccattaatgcctttcccctccaacagctatcacaagagggctgtttagtgagaggacctccggctgacctttgctgacaggctccaagctctccctgtaaacggatctaatgtgaggctgggtaattagcaaccaagtagtaattgcagcttctaactatgctcggccaagattgcaaaaattccctaggggggtgcctcctagggatcccaacccacacaaaggcatttactcacagccaaaagaggggactcagccacatttctcatggaggccagcacttctctaggtcttaattaaagtggcacccatgtaaagagacagacagcaaaaggaaattagcaaataaaggagactgaccaagaaagaaatgtatggcttgcttggaacagcccattcagaaaggtacaacctctcaaggtggatggccgtgcacacgaaactcattccagccgcggaaggaaggcaccaaagagccttcgaggggcatcaaaaactgcagaaaggccaggcgcgatggcccctgcctataatcctagcactctgggaggctgagacgggtggatcacctgaggtcaggagtttgagaccagcctggccaacatggtgagaccccatctctactaaaaatagaaaaattagccgggcatggcgctaggcgcctgtaatcccagctactcccaggctgaggcaggagaatcgcttgaacctgggaggtggaggctgtggtgagccgagatcgcaccactgcaccccagcctgggtgacagagctagtctccatctcaaacaaacaaacaaaaaaaacaagaactgcaaaaaggcaggacacatgaagacaggtcccccggcctggctggccagcctggctgcctgctcctatcacccactcaaccaaaatcactcctcacccaagcaccctgtatggcccactgttcgcatcacaagattctagatgccaggccatgtggtctatgctaagagatccgtagtatcatctgctatgatttggtgattccaccagacctgtccacaggcccccctaccgttagctgcctacatgtattaacatgtttcagaataacgtgcaaaatccccattgagaaataaagatgtgagcacttccaaatagagcagctgccctcctcatgactctaaaaatacctaaaactgcacaaaaaagaacattgtcagacgaaaagaatcatccctcctcactctaacaggacaacaagcgatgcccaacagcacagcagcgcctgtttcatccttcctaagaaaaccctttatttttcaagcccaccactccccactccaatttcctttatctgttttgtacttaaaaagtcacttcactgaactgctgtttgctcacgataactcctgaacctctgtcctcaggagaggcggcaagttcagggggcatggtagctttcccacgtggaccagactttctgccaacctgaattacaccctagacgtcttcaaacttcatttcctctgccactgtgctgcccgatcccccaatgcattcggggctgtagagactctctgggttgaatccagttataaaaaccagggtagcagcagccgagtgcactaattcaccctccatttccttctccaaacaattaatatacttaataactccagccccgacgacagatttctcagacacccctctattaacctctccccgctacaagcagtgggtctccaccagaattcttctgttccctatcacttaatcattttttaatccacaacaaggactttgtgccacactgtggttttgttctctcttaatcttttataagggaccttatcaaaagcttttagaaaatacaagtgaattttgcctaccaggtcatctttattattttagaattctttatgaagaaattatagactttaacattgtaaatgaatatttaagactcagcattcacttagacatgcaagtctggctcaggttatatttaagtcgctgtattacttccaccttcagaaggattcttgtctgcctcctgggatggaatgacttcccctccccaagcccccaggtgccatttctgggattcccccaagactttctggaccagctgaaattgagtccatattgagtaccaatgggacttagagtgcattaacagaacctcaaaccaaggaacaaaagtcatcgagccaagggggcctggctatggcagcctatccgactcctacctcctctacctttccccaggtggatggcagggagcagcaggctcccctgcctcacagctggcccgcacatctgcagggagccaatgacagcttcttgatgttgacatcacttaggctgcctcctaacacttgtttgttgtagctattatttctaattagcacttctcaacagaaccagtgctcagcaccaaggttcctcctgacggaacaattaaagaggcacaaggggcgggggtgtttcctaaaattattctcttggcaggtttcaaggtaaatcatctagtcaaatgcacatctcttcaagagctgcctgtggacagggttgaaaagctgtagcaatattccggaacccctgtttgaaagcattcccatcaagttaaatgaagggttaaggtaatccaattacaccaatgtgttttcctgatcaccaggggaatcctcagccttccccgtaatctgctcctaacgccccatttagtccaatgctgcactccaatcaccaaaaatgtagacagggttcccactcctacagccagatgagaggtgcctgccccttctccaaaatgggatggtgaaattaacacatttcagaaaatattctacagagtccagagtccagggcacgctttatccttgaggaaaataataaatgtcgagtcctaatggcatgtcaattaaaggggtcaccataaacaagctgttcaaactttcccctccactcttcgcccgtgcctctccaatctgggtgccctggaggacggaacgggaactgcagatccaggcactccattatggcaacccagcaagcagttcagcacggacttaatgagctcttggaaggaaacaggaagtctataaagtaatttaaataacttccagtcctgaaataaaggaaattaaaccgctggcacaaacctctctgatggacaccttctttgtccctccgatcacaactacaactacagcggtcatattgctctccccaagaccaggccccaaattcccctaatatgaaacacaaaggctgtcagtcctcagagctctccaagctcctgcagaggcttaagccatggatgtggcatggtgtgcagcaagaacacgggaatccgcccacaaaccccgcgctgggtcctgccactccctagctgcaagaccttgggccaatcatgcaacttcacagggcctcagcgtttcaccatcaacaaaggaaagctctgggcctggccaaatgacttctaagattattaagagggtcaaatgagcacatatgagaacagcgccaattgaaaacacaaataaacgtcggtattttccagctgcccagggccttaggctccagaatttctcgatgttctgctcaggaggcactgtcctatcttggtaattatgaaggcatattcatacgttcttttactgccaggtgcggtggctcacgtctgtaatcccaacactttgggacaccaaggcgggtggatcacctgaggtcaggagttccagaccagcctggccaacacagtaaaaccctgtctctactaaacacacacacacacacacacacacacacgagccgggcatggtggcgggcacctgtaatctcagctactcaggaggctcaggcagaagaatcacttgaacctgggaggctgagattggagtgagctgagctcgtgccactgcactccagcctggtgacagagcaagactccaacataaaataaataaattaattaattaattcgttcttttgcttctcctaagcccctcagtgtagatacttatttgcatggacaatgatcagtccaactaagcatgattttcttatcagcagagactgtgtcttctcatcttctgtaaaccagtgtgcccagagccagagcaccaagcagccaagaagctggtcctcaataaagggctagaatctataacccatgcagttatccagacatccttaagcaccaaaatgctaacaactatccatcaactctctacaaaaagagacaaacctaataacaagataaattccataactggttgtgagcctacaaggcggggaggggctgggggcgtgggaaccccgcctgtgcaactccttgcattaccaggccctgccctgagtgcaatccaaccacggagttctggcagtttcacctggtaaacctaagctgctggatgctaaggactgtttctggccacagagttaagtttactttgttgataataatcagccagatatggactggtctgaccagtactccggatccaggatcacaaagaaaagacaaacttaaaagaagcttaaggtcagcctcgttttgctagccctctaggtattactactgacaactggtatggtcaacccttgacccctaaactggtaaaagccaagagtaaggctggacattcagtgtggccaagaaagctacccagcttctgggcagaagcgcaagatcctggtgctccggaaagagaaccgttgggcccggctcaaaaacagaccctcccaaaccaaccctgagaaaggaaatcacaaacagaaatctaacttttctataagggcacactgcacaagtgttcctgcagcttcacaaacaggttctgtgggaatctgctctatcgctcccatctgtcactggcggggtaagatctgtcttgcatatcatggcggtctccatcccactggagaattcaatggtgctgtcttgcatatgggctgtgaaacttgaacaaccggattctgagggtccagacgtctctgtttgagcaacagctgccttcctttaaaggtcccacagttgagcaatagagttctttactcaagagggctgttccaagtcttgagtaaccacccttgccctcaagggttccccagggtgaagccccattgcctctgcctcaccaaggaggcagcgactcagtcttctcgctacacatctgtctcctcactttccagtcagatcacagccagtgggacacaatctgacaaagttctgtctaaggtggggtaatctgaaaagcaaatacagatcatctccccccagacttattcacagcactccccactggagccaggtttgactttccacaaagttcactggccagaatcataacccacacatctatggctcttccttctttaaccatctttcatgtaaatccttcatctaaaaggggaaccacctatctatgaactttaaatttcccagtatccatgttaaaaaaggggaggggcctggtgcagtggctcacagctgcaatcctgacactttgggaggccgaggcggcaagatcgcttgagcccaggagttccaagaccagcctgggcaacacagggaaagcctatctctacaaaaaaagaaaaaaattagctgggtgtgatggtgtgcacctctggtcccagctactcaggaggctgggataggagaattgcttgagcctgggaggtggaggctgcagtgagccatgattgcaccactgtactcccgtgatttaaagcaagaccctgtccaaacaacaaaaatgaaaacataaaaacaaaaaaataattcaaggctaggtgcggtggctcacacctataatctcagcactttgggaggccaaggcaggcagattacctgaggtcgggagtttgagaccagcctggccaacatggtgaaaccccatctctactaaaaatacaaaaattaaccaggtgtggtggtgcatgcctgtaatcccagctgctcaggaggctgaggcacaagaattgcttgaatccaggaggcagagtttgtagtgagccaagatcatgccaccacactccagcctgggcaacagactgagactctgtctcaaaaaataataatactaataaggggaaaaaagaaacaggtgaaattcattgtaatatgtcttatttaaccgaatctgtctacacattatttcaaacgtaatcgatctaggttttattaagacagtttccccttgttttcctactaagcctgggaaaactggtatgtgttccacactcacagtatggctcagggcgaaccagccacatttcgggtgcttaggggccacatactgcagtaatgtaaaaccctggcttcctctaatcatgagaacctaaaacataactctgatctggccccactgtaataattcatgcttgtagttctcactcacagactttacagaacttaccgctgctcaagactctttcccacggcattaacaattatatttgggtgacatgtcaagaagttaagctgcccgggcctggagttaacagattttcacagaattgtgtacaacttatctggtccatcagatcgtctctctggggcttgtccaccattaaactagacccctggggtttcttaatttaaaatcctcataaccctttaacttgaaaactcactgtctttgcaatgacatgtggttaactctgtagtagccacataaacatctcctcattcttaaacaggagacttccattttgacctaatctgagattattctgaattatttctgccctagtcacatgtacgctacagacatgagattacacagaataatcaactgaggtggtgcctacacaatcttttgtttttttgttttgagacaaagtcccgctctgtcgcctaggctggagtgcagtggcaccatcttccctcactgcaacctccgcctctcaggttcccaggttcaagcaattctcctgcctcagcctcctgagtagctgggattataggcacatgccgccacacccggctaatttttgtatttttagtagatacagggtttcgcatgttggccaggctggtctcgaactcctgacctcaagtgatcctcccacctcagcctcccaaagtgctgggattacaggcatgagccaacatgcctggatacctggaaaatcttaaggcacaaacaaacacaggacaaatccacaggcttgggaatcactataagcagaagaaaaatgtccacagggcataaactttggaggcatgctcacagcaaccgctaaccagaaaacttcgcaggctcagtccagatctgggcaggattggctcaggggtgacccatctatcctgagagctgtcaggaccccatcctattgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaaagcttctgcaggctcatccatccagattcagctctaagagcagggcaacccggggaaaatggaaacatacagaaaacagttcacttctggcttgtcgctttggctgcaggcaagagaaggtgtgcacagagttttgaaggaaagactggaatgggctgacactgggctttgttcccggagccccatggggacagggctggcttccgaacctagaaatgcagagagctgctctccaacaggtggagggcccacccgagtaagtatcccgggcagaagaacagagcaggcaccactgtctgtcaacaccaggctcggcatcctcccatcccccagggtccctcgacctgtccccagggcactggagagaggagggagggacgaagggcacgcggtgaaaggaaggaaggaggcgcctcttcttggcgagctgatgggtgtgagtggtgagcatgaattaaaaagccatccgggaacaatggtcttttcatatttggagcctgttctgcacaaagctcagcttgttctagtgggaggactctgctttccatttttttcctaactcatttcctagggttgtggcaatgtctggcactcggctcaacccaatagagtatcctttaactgaaggatgtgccaggcaggcctcctccttgacttcgtaagtggtggcattgagacacacaaaaagggacaacttcaggaagcttttctgtctcgacccgtgggctcccaaagagctcctgggtgtttctctgaatagctgcctaacccacagaaacacacactggatgttttcagcggccaaacacccatttccctctcaaattacgctagacatgccacacccagcagacactccaaagcctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacacccttgtgtagtcccctccccttgggagtgagcaatacatagggactcacttcttaccaacagcatgcaaatggaataggacaaatgtgataggacaccacttctgagatgaggctgcaaagaaaccgtcattttagtcatctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagatttcagtctgtccccagtcaagtcttcagatgagaccacggccccaggtaaacactttgaccttgcagcaggggacccagctacgccacagcccgattcctgacccacagaaactgtaagataataagtgcttgccattttaagctactgaacttaggggtaatctgtgatgcagcaatagataacaatacacatctccattttgcaaatgaaaagatataatggaggccaggagtgctgactcatgcctgtggtcccaacactttgggaggctgaagtgagaggatcacttcagctcagaggttcaagaccagcctgggcaagatagcaagactctgtctctacaaaattttttttaaaaaaaggttagccaagtgtggtggcacatgactgtcgtcccagctattcaggaggctgaggtggaaggatgccttgagcccgggaggtcaaggctgcagtgagccctgactgcaccaccacgcacttcagcttggacaagacagtgagacccttcaaaaaaaaaagggggggaaagaaaagaaaatatataattttggccagtaagtagcagagattctcacttaggccagactgactctctctagccaccttcctctcaccatgtggcattacctatcaagcccacattccggtccatagaccagaaaagcagcaaaactccctgggcctctctccatcctcacagatgacagagacacctaacagtcatgcccccaaataaaaggataccagattgctttggaattttagggttgaagaaagagtgaggagagaatccagtctaactttcttttacagataaagcatctgagacccacagccataaagtaacggacatggaactcaaacccccgccaggatagcacgtgactctttagggattccaggaaacttctactcaaacatgctgaacaagcttctacttctctggccaggagaactccatcagtaactctggtcttctcttttggcacaccaagattaatgctctgtggtggctggctcccctggcacttggcagcttctcctatacctgccccctaagtccttccacaaagtgacgagatagagaaggtagatcagagcgtcttctccttggttaataccagaatcgacatatcacatatcacaactgcatactgcccacccagcttatgctgaggtgtgatctaagtttgctttgaaattcagtgacatatcagaaagacagcacacacatttccatcaagacagctaacttgggcaaaggtgttctcaagtacccaaggcgattgattccacaagcttgcagatcactaagacttccactatttttacaaacacataccatagatgcttacagtaaatatcataaataattaaagctaagtagcctaaggacattttgtgaagcatctttgctgcttttttttaaattaggttctcgctaattcacaagattgaataatctccaaaaagcctccaaacacagccacaggccagtgctatttaagtgattctacatttttgcaaacttttaagcacatattttcttctcatgacaaaaagtaatagatattcactatgcggagctcagaaaacaaagtattaaaagtagcctgtacttctaccagctggaaatagccatcagtcatatgtaattctttagcttctcttctatgcatattttaaaaattaaactgaagtcctatagtccacagagttcctttcattccatttacatcactgttttcccacatttataaccaggaggcaggagttttaaatagctgcataagcatctaccatatggctgcaccacagtttaaatcaatcccctgtaagatttttcagatagtttccatttttcactattataaatgtctgttataagtgtctgtagcaaaaatctttatgtataaatttcctttgcacgactctcagggtttccttattacaaatggagttgtcaccagtcctgatccgggtattagacgtaagataattaaagggaaaaaaaaaaaaaaaccatcagacaaagactccgcccttgtgaagcttagattctagcaggggaaacaatcaaggataatacattttttgctaggcacaatggctcacacctataatcccagcactttgggaggccaaggtgggtggatcatctgaggtcaggagttcgagaccagcctggccaacatggtgagacccccccctccccaccccgccccatctcttaaaaaaaaaaaaaattagctgggagtgatggcgggcgcctgtagtcccagctactcaggaggctaaggcaggagagtcgcctgaaccagggaggcagggattgcagtaagctgagactgcactactgcactccagcctggacgaaacagcgagactccatctcaaaaaacaaacaaacaaacaaaaaggataatacatttttttaattgtatagtattttactagtggcatatggtatggtcagaaatgcagaggcagaacagagtgagggggtcaggaattcacggggggaaaagctacacatttaaataaaccttaaagtttcttgacacatactgccaaatgatcctccagaaagggtatactaatttttatacccaataaccagatcagggtatttgcttttttttttttttccacttagttcaaaaaaacaaaacaaaacaaaaaaagctcaaccttaccagtaatcaaatacgttaaaacaatgaggtctcatttggctcttcaaatgggcagcctagatttattcttcatgaattgtccatttgtgttctttgcccatttatctctttttatttttgtttaccacaataataactacataaaaacacgactttttttttttttttttttttttttaagtagagacaggtatcactatgttgcccaggctggtctcaaactcctgggctcaagcaatcctcccacctcagcctcccaaagtgctaggattactgtgcctggcctccatttttctctatctgtatgcatcaatctttttttttttttttttttttttttgagatggagtttcactctttcacccaggctggagcacagtggtgcaatctcggctcactgcaacctctgccttttggtttcaagccattctcctgcctcagcctcccaagtagctgggattacagatgcccaccatcacgcccagctagtagagatggggtttccccatgttggccaggctgttcttgaactcctgaccttgtgatgtgcctgcctcaacctcccaaagtgctgggattacaagtgtgggccactgcacctggctgtttcattcatttttaagagctctttatatattaaggatttaggacacactgtcaattccatgtgctctaaacaccttttcacagtttgtcatatgccttaaaattttgtgattagtgaccagcatgcacaattttttttaagtagactacatcaatcttttctattacaatttcttccccacaaggcttaggcctaatattcctcactgccctatattcagatcaatattaacctatattttcttctagctcttttgtgattttagttttacttttacctctccaactcacctggaatggatggtaacatatgctatgaaaaatggctctaacctaatttttccgccatttggctatctaactgtcctacaaccatttattgcataattttataatacgagaggcagtgaagtgcagtgatagagatcactggttttgctgtcagttacatcagtgtccaagtctggctgactttgagcctgttacttaaactccctgagcttcggtttccttcactataaaatgaactattagtaatgtattagtagtatccaattcatctggtttttatgaggattaaataagttcatataaagtcttggtctggtgcagtggctcacgtcttataatgccagcactttgggaggccaaggcgggaagataatgaggccatgagtttgagaccagcctggccaacaatggtgaaacccagtctctactaaaaatacaaaaattagctgggcatggtggcgcacacctgtagccccagttacttgagagactgaggcaggagaactgcttgagcctggcagacaaaggttacagtgagccaagatcgtgccactgcactccagcctaggtgagggaacaagactctgtctcaaaaaaagaaaaaagttggctgcgcaccatgggtcacgcctgtaatcccagcactttgggaggccgaggcgggcagattacgagaacaggagatggagaccatcctagctaacacagggaaatcccgtctctactaaaaatacaaattagccgggcgtggtggccggcgcctgtagtcccagctactcgggaggctgaggcagaagaatggcgtgaacccgggaggcagagcttgcagtgagctgagattgtgtcactgaactccagcctaggcaacagagcgagactccgtctcaaaaaaaaaaaaggtcttcagcataatgcttggcacttagaagttctgaagcgttatgtgagctgttactctgattcctctcacttaacatgaaatacaacctttaccagacacatttctatttgattccatcccactgagtgatctctatattttctaaccagtttttcccagtatatgagaaagctaattatcttttaaaatgttacgttgtaactgaactccttaattaaatttaaatgtgtcttgggccactaggaagacagtaacatctggaaataattttctttgtttctttttaaccattatttgactttggtttgtccatcctgaccagttcaataaggtaggaaaaagaaattagcaaattagtatattccatagtctccattgtgttcccagtttcagaatgttgcctctcatgattcatcactaagtctgagggtgttggctgcctgtttcttcattgagaagtcaatgcatcctctttcaagcttgagttttcaaaattctaagcagactaggaataagggtagaaaattaccaaatgcagtcaagtgtgacggctcaagcctataatcccagaattttgggaggccaacgcaggaggataacttgaggccaggagtttaagaccagcctggacaacatagtgagaccccaatctctatgaaaaaaaaaattaaagcccagcatggtggtgtgtgcctgtagtcccagctactcaaggtgatgcaggaagactgcttgagctggaggtcaaggctataatgagccatgattgcaccactgcactccagcctaagcaacaaaacaagacaaagaaagaaaagaaagaaaagaaaaaaaagaaagaaacgaaagaaaaggaaaggaaagggaggaaggaaagaggaaaggaaggaaaggaaggaaggtgatcaaatgtatctctcacacacatacacacagacagacagctgtcccttgctatatctcccatagatcccgaaaatctgaggatagtcaagtccctgatataaaacagcataatatgcacaacctcctgtatactttaaatcatcttttgattacttataacacctaatgcaatgtaaatgctatataaatatttgttaaactgtatcatttaaggaataatgacaagcaaaaaggctgtcgagtccacaggtcctttacatgttgagtaaagacccaattttttccccaaatatttttgatttgcagttgctggaatctacaaatgcagaacgggtgactatgaaggccaactatattatgtttttcttcttggctctacatacatgattatttcaagagaagacattctgatattaagccccttcttacatttccaggataaatcctatgtggttatgattcttttaaaatgctaaattcaatctgtgactgttttatctggcatttttgcatctccactcatgtcggaactcaatcttcagctttctttttgtgtaacctttgtgatggtgttggttcccagaattatgctagctttgtcaaatcaactgggatgctttacctctttttctattccctgaaacagtgtatttagcaggcaattatagcatccctctaagtttaaaataacttatcctttaaacttcttgcatccagagccctcctcataactgttttttgtttttgtttttttgagacggagtctcacattgtcgcccaggctggagtgcagtggtgcgatctcggctcactacaatctctgcctcccgggttcacgcaattctcctgcctcagcttcccgagtaactgggactacgggtgcccaccaccgcacccggctgattttttgtatctttagtagagactgggtttcactatgttggccagacaggtctcaactcctgacctcgtgatccacccgccgcggcctcccaaagtgctaggattacatacaggcgtgagccaccgcgcaaggccagaactttttttttaatgctcagcttcttccccagtttctgatttaaagtttcagacatccaagtcatttcccaacagccatgtcactgggattttcaaaggtgttgcattttaagttactgtgttttacattacaaaacaattacttcaaatgcaacttacatttgttacactttttctatcatatcaattcctttttagttttctgtatttggggttttctcttttctcttttcttaattaaacatgatagtgatttggtctacttccttggccttttttcccaaatagcttttagatttatcaattcagtgtttttatctgtttttctaattcattaatatcacttttatcttacaattcttttctccagctgtctttaggcttgttttatgctttccaagtttgagttgaatacttaattcatttattttcattttctttaataatgttttaaagctacaaatgtgcccctgaatataactttggtaataacccatacatttagatatacagagttctcaatatttcctaatgatcctgtaacagtaacttcatttcctctttgacccaagtgtgatttaggagaatatttttaaattttcaagtaactggatttcattaacatgtttaagtattctatggaggataaaaacatctctgaaaggagatgaaactctggcaaataaaaaaaaaccttttaaatagaaaacacgacaatgttaaaagtgaaaaatgactcatataatgctgtgatggccatatctacagacactccttgtagaagggatataaccaccattggtcctggggcactgagagatctgagtgtaagcaacacaaggagagagggaagaggatgttaagtctctgtgccttctgaaaattttatcttgggcatatgctgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaactttgtagtgccaagttaaaaagaaaagaaaaaaaaatggactccataaatcagttttccaatttacgttgaagaaatctgtttcctactttctaatttctgcaactgggaaattctgtatattatgttaccatataatgaaggatgccggtaaacagaaatccacacgcctgcacacacaacagattacattgtatgtaattgcaaacaccaccaagttatgtactcttgggagcattattagtgagatgtggttatttaatgcttcatctatttaaaaaaaaaactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaattgctggctaccaaaacctccatcccccagcagcagatggcagggccagccttttgtactttacttgaccatttaagaaactcacaaaggggccagtcatggtggctcacacctgtaattccagcactttcagaggccgacgcaggcgaatcacttgaggtcaggagttcgagacaagcctgaccaaaatggcaaaaccccgtctctagtaaaaataaaaaaattagcagggtgtggtggcgcacgcctgtaatcccagctattcaggaggctgaggcaggagaatcatttgaactcaggaagcagaggttgcagtgagccgagattgcatcactgcactccagcctgggttacagagcgagactccctctcaaagaaaaaaaaaaaaaaaaaaactcataaaggtacacagcacctgggggcttccattagcatcagaacacccacggaggcacgccccatgggaaggtggcactcagctcccaccacagagcaaggccctttaacagcgaagatgctgcagggcactgctactcgccctgctggggagaagccacccagcagccaccctaggagcctggcacagaatgcccagctgtggggaaggaaactgtgccacctgcatcgcccgtgtgccaaatggagttcaagactctgcaccgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttgggcacacgagttctactccaggagacatttacatcaagttctactctctgaccaacattgaacattttatttttattttatttttttacacagagacagagtcttgctctgtcacccaggctggagtgcactggcatggtcatagttcactgcagcctcgaactcctgggctcaagtgatcctcccaagtctacctcccgagtagctaggactacaggtgtgcaccaccgcactgggttaattttttgtttgttttattttgtgagacagggtctcactcttgtcatccaggctggactggagtacagtggcgtgatcttggctcactgcaacctcgacctcccgggtttaagcgattctcccacctcagcctccccagtagctgggactacaggcatgcaccaccacaccgggctaatttttgtattttttggtagagacggggtttcaccacgttggccaggctggtctcaaactcctgacctcaggtcgatccgcctgcctcagcctcccaatgtgctgggattacagacctgaaccacttcacctggccctggctaatttttttttttttaattttttgtagatatggggtttccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaactcaattcggtgggatacctttttttatcttggtgttatttgggtattctgcactaattctggggcaccaggtaagtttctatcgaggggtagaagctgacttctgtccccgtcccccaagaccaaagaggaagcctcttctgccaccactgaaatactatctttagaggaaggcatgctattagctcatcaagcacaaaacacattcgagctaaacattacagtcaaatgtcacagccacttcaaaatagaggtacccaaaaaggcagtcagtcttctcagcagggctttgaaaccactgccaactgagaacttgatctcaagtcttccaacaccaaaacacctggtggaataggtacaactaacgggcagacagcctcaaactccattcagctccacagcgcctctccatgaccactgcagctcaacctctgtgctgggaagtgcatgcataggatggagccatgtttctagaaccatcagagacaaattttctactacaagtgatactgcacatgacagtttattccttggctggcctctgatagtatgcatttgaaccatatggaatcaccattttttttattaaattagagctgttaaataataacatcatggaggaatgtgttaggttctgggcaaggatcttaaatacacagttttggaacaagtgtagggaggggcccaagcccacggccggtgcccaacggtggctacacactacagcagcaaccggccttcatcctccaagtcctccttggaatttgggtgaaactacttatatcttaatctaggcagctggagatgaagacaaagacaaaagagaagaggagagaaaaggaaaataatttgatagaagtattttccatcccaaattttgagatcctggcacgaatgatataatctagatacccaacaacctatacttgttccaaaatcgtgctgttaagatccttgcccagaacctaacacgttcttccatgatgttattaacaactctaatttaatccaaaaatggtgattccatatggttcaaatacatagtatcagaggccagccaaggaatgaattgtcatttgcaatatctcttgtagcagaaaatgtatccatgctggttctagaaacatagctccatcctatgcacacacttcccccaggactcctggactgccaaaggcagcctataagccatcaactagcaactggacatttcatctgggcgctcaggaggtacagacctaccaatcacgggagtgaaggtacccaggccaaggggctgtacaagaagggcagagaggaggccaccatcctgaacacatcacagactgcccatctgtgcccttcaagtgacctctaaagtgtggtatcaatctccactgaacctttgctcttattcccacaacacttggattctttctttacagggacccatgtgaaaactctttatttttttattattattatttttgagacagggtcttgctctgtcgcccaggttggagtgcagtagtacgatgttggctcactgcaacctctgcctccctggctcaagcgatcctcccacctcagcctcccaagtaactgggaccacaggcgtgtgccaccacacccagctaatttttctattttttgtggagacagggttttgccatgttgcccaggctggtctcaaacttccaggctcaagtgatctgcctgccttggcctcccaaagtgctgggagtacaggcctgaaccacggtgcctggccaaaaaccctttataaacactctcttttatttttctctcaagtatgactctttgggcctcaccaaaatacaatttcacaaaataatgtcacattatttgggggaggggagaggccaccaaatttcatctcgaagcctcttccctcatttccaaggaaataggcattgttggaacaggtaaggctgtaatatttggtttagctttgccctcctgagccacctacctctagaggcacgtgggggtctctttctttgccaactgcaccaattcctccacaggaccgtgcagtagctgaataacaacccccgaagacgcccacatcctaatatccgtaacctacaaatatgttaccttctacagcaaaggaaactttgcagatgcgatcaagtgaaggatctttggatagaggagatgatcgtggattatccagggggcctgatgcaatcacaggggtccttacaacaggggcaaaggagaggacagagtcaggcagaagaaggagatgtaacagaagcatgacacagagtgatgtgaggaaggggccatcaacccagaaatgtgggggcctccagaacctagaccatgcaaggaaatgggttcctcctcgaaaccgctacgagaaagcagccctgccaacaccctgacttcagcctactgaaactgatttcagacttctaggctccagctacaaggcaatcagtttgcggttttttgcatttttttttttttttggaaaaatgaaagctgatttttattttatcatcaacagccattctttagacatgaacatgcatacgtaatattctatgcacacatcgcagttttgaacattagttaataaagtttaaacatactacatccttacagaaaacatcaaaatgcaaacttaagtttgtgttttacaccaacaagtttgtggtaatttcttcttcttttttttttttttttttttttttttttgagacacagtctcgctctgtcaccaggctggagtgcagtggtgcgatcttaactcactgcaacctccgactccctgcttcaagcgattctctgcctcagcctcctgagtagctgggattacaggcaggcaccaccatgcccggctaatttttgtatttttagtagagaaggggtttcaccatgtcttgatctcctgacctcatgatccacctgcctcggcctcccaaagtgctgggattacaggcatgagccaccatgtccggcctatgtggtaacttcttacggcatcaagaggaaactagtatagccatctggagaaagggggacagaaccactggacacacagaagcaggggtgtccctgaagggttcaccctaccaaggggttcacactaccctccttctccagaccctagggaccagctgaaacctctctttctccatcaccaaaaattaggaccaaaggcctcagatgctgtaatcaagagctgtgtcttttttttttttttttttttttttgagatagggtctcactctgtctctcaagctggagtgcagtggtgcaatctcaactcactgtaccctctacctcccgggctgaagtgatcctcccacctcagcctcctgagtagctgggactacagacgcctaccaccgtgcacagctagcttttgtatttcttgtagagacagggttttgctgtgttgcccaggttggtctctaactcctgggttcaagtgatccacccacttcagcctccataagtgctgggattacaggcgtgagccaccacaccggccacgagggctatgtcttaggagaggtgttcagtggagtatcttagcattagacagaaaaaacctcccatcctggcctaccgcatttgagatttataaatatccaaattaaccaaggaaacaacagaaaaacagtagttggacaaagagtttgtgtgtgctacatgtttattttatctaataggagacaccgaactagaaacatctacattcaagaagaatccctggatccacagttccttttatcaattcacaaaagccaggccgagccaaccttacccaatatattccacaggtgggcccgcctgaagcctcgctgtgatgccaggcagccagcctgaagaactggaaagccagggcccgtgcacgctgggctcctgaagacaaaggaaacagaatggctcgggaaggccgtggcaccctgcccgcctccgtggtagcctggggccactggatcttgctgtctccgcagcacctgagaggtgtgagccaggcagccaaccacatcagaagctggctgccggctgccccaattgcacaacacctccaggggagccagctttccaggactgggttttacacaccatacgggcactggccatgttgacccagtcaaggcatggcaccttgaagaatggcccacgcaaagaccggccatatggacagaaggcatcctgccacagagcgatttctgaatcacctctatgcaaagaatagtcttctctcttacgcaaaggagatcccatcaccaccatctcatttctatcccaggctcctccagttctctttcaatcacaagccagactacccaaccacttaactctctaggcccagatatgacttaattctcccactcctgcatgtttgttgccacttccccattttgtgttaacaattaacctgaagtattatgttaacaattaacatgaattgtgttttggtttttaaggtcggagtaactaggattactcaataggatttaaatgttcaattttagcacacatgtacaaggcgctactttgtacatgacaagatgaagtggtttaaaaaaaaaacaaaacataaccacctttcacaaagggttctcattcagcctcctgcttgtgaaagatacgactttgaatagtgaaagtcccaagaagggtaattcaagcaaaactggtttctagtttgccttgattcaaattctttatgctacttgacccatttctcttttcctcttgcttctcctgatgcctctcaaaataataataaaccaaccccagaaatagaatcctgtcttccttagatgtcaccatatgactaatttatggcctttgtttaaagcccttacaccagagttgactccagtaatttcctcctcttctatttgaatgtccatttacagcctctctgtaacctctgggtgaactgagaatgttctctgtgcctctcatgatgtggattcgcaccctggtgacagcagagtggctccgagcagaatctccccattacagctgaagcccactgggaccctacccaagttcacgtgtatatcccaagagagtttgctgaacactccttatgccttaatgcacctttgaaaaaaaaaagactaagggggctgggcgcagtggttcatgcctataatcccagcactttgggaggccaaggtggaaggttcacttgagcccaagatttcaagaccagactaggcaatatggcaagacctcatctctacaaaaataaaaataaatcagccaggcgtgggggcatgtgcctgtggttccagctgcttgggggtgctgaggcaggaagatcacctccctcagccttgggaggttgaggctgcatggagctgtgattgtgccactgcaatccagactgagcaacactgcaagactcccatctcgaaaaaaaaaaaaaaggcaaaaagatatcaaaggctgagtgggcaatttgaatgtgttcccaagacgtgatgggaattttctacgtttggattcaggggagtggggtcttagttttgctctcattcagggaggtgggtcccaaaaaatatcccctgttggccttaggaggaggaatacttgaaaggtatatctgaaaatgctccaagttttttcctgccccgctttccagtggtgcccttcgccaagtcatgaaaactctgccaacactgttctctctccagcactcacctgggctccccaccaatgtcttggctgccgtcacgactaaataatgccttctcttcttcccctccacccacccctctctggtctttagcacaacctatcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctggactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcctgggctcaagcaatcctcctgccttggcctcccaaagtgctgggatgacaggcgtgagcatacacgcctggccatggttttgatcttataaaataaattaactctaaggccgggtgtggtggctcacgcctgtcatcccaacactttgggaggctgaacggggtagatcatgaggtcaagagatcgagaccatcctggccaacatggtgaaaccccgtctctactaaaaccacaaaaaattacctgggcattagcctgtagtcccagctacttgggaggctgaggcaggaggatcgcttgaacccaggaggcagagactgcagtgagccaaaatcacaccactgcactccagcctggcgacagagtgagactccatctcaaaaataaaataaaataaaataactctaaataataaatggcaagaattttctttaattggcattttgtggggattcaccccaggcttggctgtgtgttatcatactctcttcactctgagaatctgaactgtctccctgaaggactgaagctagcctctgtatagtctaaatgctaaaactggctgtcagtttcctcaatgcttgccactgtgattttattctgaaagctacagctcttctcattcaaaggttaccctccctcctaaccaacccagaaagaactcactacccagctctgcttgcaccctagtgttggggctcaagcttccggttccgctaagactctgacctcgcttctaaggacacacacctcagaggcccagagctccgctgtatcacacactcattgtcacatccctcgatgcatcattcccagaatcctcaaggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcagaaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcgtgtgtgtgtgtgtgtgtgtgtgtgcgtgtgcgtgtgcgtgtctgcacgcgcacctgagtgcacatgggctgcctggtttacaggccaccacaacccttccaccaagtgtgaacacacatacacttccttaccaaggtgcccaccggaaacccctgcctggacccctgcagccctcccagccacactgcagcatcgagggaacagcactttgcctccccaaacctgccctggctactgggtgaccccgctctgctatccccaccttcaccctgagatgcacagactgtctgctctaaagggcatgaacctggagattgtgagtcatcacgacgcgcaggaagcaacgtctcagtccaaaccctgagcccgttcctagagagccttctccgctctctcacccctcatcccacgtagagcaatcagggctcacccgcccccttccctttctctatggcttcttcaagatctcctcatccatctgcccacaactggaactgtttatttgtttagcccactggtaagaaaaatgagagagcgggctggcattcctggctgggcataaacacgtttttaaaaaatgtctgttccaactctgtctgggtcccgtactgagccctttaacctcctgcaagcaccatggagacattccatgggaactatcaccattcgttatcatcgctgaaagacaaaatccactgtaccctgcaacatctcacacagatccttcacattcttggtttgagagctgactatgcaagaaaaaggaagcaccatgactgtgggaaaggccactgtcaccaggacaagaggcaccagcaagagccctgcatcaattactctacagaggcaccgggaggcctgattttaattttttaaaaatacatttaatgaatcacatacgcaaactttacattggcagaacactcccttaggatcatgagcaaatttctgatcagatcaaatagcaaactgcccaaggaaaccacgaagaggggtgatgttgctatcacactatcaaaaagtaaagacatacttctgatttctcacaagaaatttcccaacaaaagctctctgtcttagattccgaaagaaaaacatcccccacacagagtgtaagggccaagaatggcctcaccatatgggacagcttctgaaatacacagaaaacgggcaacgcgggacccatgggacaaaccactgtgtagccagctgccccggccaggcccgtggtgttgactttggcagtgcttgtcgaccatgactcagcaatagtcatcgaaactgaaatcaagtggaactgatcagttcagacctccaatgttgagtttgactcaacgattcttcaatgcccctggtcttcctgaaattctccatttaaatatttactggtttaagggtaaagtcagggaggcacgggcatggttgttggaccttttctgtcttatcctattcaaatctggctgaactgagtaaaacgttatgcagcaggatgtcttcctatataatccacttcatcccgcccccccaatactcttccataggggttcaaatgcagatctgaaccaactgctcgatgatcccccaaagccatttagtctctgagcttttctcatctacaaaatgagatgtgtccccactctgcataccgtatagagcacctgcaaggattagttgaaagggtataggcccaaggactttgaaaaatgaagctccttaaattattttcccgatgtcctcagacagacttggcaccttacccttttactcataattaaagatttgagcagctaactcagaggcctaattgtgatgctaagtagacatatagtggctcaataaaaggaaagactgaaggggtttagagcagcgaggaaagacaatcgaggaaacggggctcgaggttctgggacgagggcctgctgagctggccagcccagccaaggccacagggatacagtccttccagtcactcaagttaaaaatcttgcagtcacccttgactctatgtcctgtcttgtcccatatctcccttcaaaatctatccagaggataagcacctggagcagatcgaatagcatccctcctagaactcatgtctaccaagaacctcagaacatggccttatttggaaatagagtctttgaagtaatttataactaaattgagctcagactagatcggggtaggccttaaatcaatgactgagccaggtgtggtggctcacacctataataccatcactttgggaggctgaggtgggtagatcacctgaggtcaggagtttgagaccagcctggccaacatagtgaaaccctgtctctactaaaaatacaaaaattagccaggtgtggtggcgggcacctataatcccggctactcaggaggctgaggcaggagaatcacttgaacctgggaggtggaggttgcagtgagccaagatcatgccactgcactccagcctgggtgacaaagcgagactccatctcaaaaaaaaaaaaaaaaaaaaaaatcaatgactggtacccttagaagaggagggaacacacagaaatgcacacaaggaagacagccacgtgtagacgggaggcagaggctggagtgacacagctccaagctaaggaatgagtctttactcaaatgtcaccttctccgaaagcctttcttcactgtgtccaccgaacctgccaactactgctcaccccctgccctcgtcccgcctcctctccacagcatttaacatcatccaaaatactataatgcacttagtaatgatgtccagtgagggagatgaggtagtataagctccaagcagacaagcatttctctctttttttgcccccattggagtatcaccggcaccaacaacagtgtctggcacacatgggactctcaaacaaaaggtcaagggcagcccagggaagccccaaggctggaagctctcgctgagaaagccaggctgggagaagcccgtctccctgagtcaggcctgcaagccaggcaggcagatggtgaaaggcaggagggagaggagccactgcaggcccctggtcagcagaacaagaagaatacggagccgggagtttgagggcagcaccactgatattcaggctgtgtcattcttcgttggggatgagggtggctgtcctgggcatcgcaggatgtttaggagcatccctggcctctacactggatgccagtagcatcctctccccaaagtgtgacaaccaagaatgtctccagactgccaaatcttggggggaggaagcaaaatcaccccctacggagaaccgctgaaactgagtttcagtccaatgacggcccacatgccacgatcccagacagcacagggccaagcaggtaacacaaatgagcgaagttggctgggaaacaggacgtggtagggtaagagctggtaagcaacagtgagctctggcaacctaaaaagtagatgttccttccacaaggggcagtcaccaccctgttctagccaggttttgccctgaagacccaaaatggccaaatcccccgattttttttttcaagagaaggttttaatactgatttttctgtgaaatgtgcccatgtttaaaacatagtatgtggccaggtgcagtgtctcacgcctgtaatcccagcactctggaaggccgaggcgggcagatcacttgaggtcaggagttcgaggccaacctggccaacatggcaaaaccccatctctactaaaaataaaaaattagcctggcgtggtggcccatgcctatgattccagctactcaggagcctcaggcaggagaatcgcttgaacctcggaggcagaggctgcagtgagctgagatcgcactgctgcactccagcctggcgacagagcaagactctgtctcaagaataaataaataaataaaataaaatatagtatttgctgaacaaaacacatctacaggctaggttttgcctacaagctaagactgtgcaacctccgcacagagactgcctggaggtggaaggggctggagggaaaccccccttaggagcctgctgtcatctagacacaaggggcctggagcaggcctgtgagggtaaggggcggagggaggaaaggctggatcccagaaactcttaaggtgaataagataagcacagcaagacaagtgtgcacactgtaatcataagccacgagggccaaagcaacagccaatgcccccggctccctcccacgatgcgctacaggcagcactgtgcttacgcaggtcacacacctaggagccggaagacccctaatgcatccttcaggtaggaccctctgctttgcagaaaaccagcgcttagaaaaggcttaaagtgagtattttgaagacggctggaatcagagctcaaatccataacctcaaaggcttcatgtcatcttgccaccacccacgccaatccttgagcctagagtaacgaagagaaaggctgcaacgaccacacacaccacgacgtcagcccaaaggccacgtggctccatccacggcaacaaaatgcaagggagctccgagggacacttccgtttcaggacaggcttacggggaggacaccagctcctcccaccctatctgtagactgggtagaagggcttcttttgagcgctctgtcttcccagagaaggacgtcctggaaacaaggcacgtgcagtattaccattaaacaacatgcacatgccagtggcgctaaataaacagcagagacagaggctgcctcacccacttgctccatagtctgcatcgaatcaaggtcactggagacaaggtaaagtccacagagccccctcatctcacatccacacagctttgctcctcctgaaagaaatgaaatagctggagtgttttggcaaagaaacgaagaggcaggtgagcaaggagagatgggggaagggaggggcgaaagaagagaagaggcagccccatctcccagctggggagaaacttccagatgggaggcagcagacgccactgaattgatggccagtctccaccaagcctcatcatgccccgcaggcaaagtctccactccccttccttcccccagccacgggcaggaggcaccacccatgaagactgagtctgagatcatgcaccattgactacccaagcccaattcttcctgtccctgatctccaagtggtagctgcaaataagcccacgtgagttgcactgaaaggatcagggcactggttctcgaggactgggaatgcaatgataaaacgaaatctcaccagcactcagtaaagccagatccaatggcagccttgggctggtcacccctaaaccgccatgtgtcagtcgggttccgcctcccagaagcgggttaccctgatttgtgagctgattattctagaagactccagggtctgaaagtatctcaacaggttggctatgtaaaaacacagtcaatcaagcagccagacactttgcagagagactccactccacgaagaattacaggaggaccagagggtctggctgtgccggatcccacagctcagcggctacatgtcccccagaaggtgggcccaggaaggccctgcaccttgtatgggaagctctctactccccaacacaatacccctcggccttgactgccccttagacaccgcctgcctcctggagacgagacattcctcagccctctcccacatatgatctccgcatgtatccattataaggatctaacttttttatggagaggagaaagttcccacatgcagaagacttacaccgcagggggaacgaagggagggtcatttagcacttgttgaaagaagatgagtatgagagcaattgggaggagaagaaaatgtcatgtcagctatgaaagttaaacaggaacgttcccctccccacaacgaccgccctgcaccgccctgccccaagtccttcccaatgcggcggcagccaccagcccatgcaggactcacacatgggcagacacccaagttaagagagggggcccgggaaggggagggacaccatggtggtttgcagagctccacctctgggaatggatttgatgtcaagtgtcagcaagtaaattgctattggcttctcaataagcagcagcagtgagttaagtgtttccccgtattgtggagccctcacggactcgatacagcagtattgacagcacaatcacacagtaatccagggtcctctaatgcctacacttcctcaatgaaaatacactttccacttggacatcagcccattagctttgggctggaatctctggcctccttatccctcccccaggcacccctgggctgcaggtctggcatctggccccctgacaccccagccaacatgaacatcccagccagagtattgtcagggcccaaccgaaaaagataaacagtcagagacctacaggaaaaggcctgctctccctgtctataaatcactggtgggaaggaaagaaaagtgatccaactctttcaggataaaaatcacagcagtcactgaggaaaattgatgttcccttgcaaagcgaaagatgttctctccgggaagatgcatgccttcaagttttcagacagactgagactcaaacttcacccaatgtgacacaggattgagacaagttatgtgacctccacaaagctcaacctctcacgccagattcgatgcttcccaaaaggaacacacccatgtcttggcagtctccgataggctgaaatagtagagggtctgctgggcacagtggctcacgcttgtaatccgagcacttagggaagcagaggtgggtggatcccatgaggtcaggagttcgagaatagcctggccaacatggcaaaaccccatctctacaaaaaatacaaaaaaaaaaaaaaaaaaaaaaaaaaaaaagccaggtgtggtggcaggcgcctgtaatcccagcaacttgggagggaggctgaggcaggagaactgcttgaacccaggaggcggaggttgcagtgagccgagatcacaccactgcactccaggctggggggcagagcaagactctgtctcaaaaacaaaaacagaaaggccagtcatagtggctcacgcctgtaatcccaacactttgggaggccaaggcgggtggatcacctgaggttaggagttcgagaccagcctgaccaacatggtgaaaccctgtctctactaaatacaaaaaattagctaggcatggtggcaggcacctgtaatcccagctacttggaaggctgaggcaggagaactacttgaacctgggaggtggaggttgcagtgagccgagattgtgccatgccattgcactctagcccggcaacaagagcaaaactgcctcaaaaaaaaaaaaaaaaaaaaaacacatagtaaagggtctgctcatttaatagtaaacactttgcaaatgcaagctatgtttcaaaaccatttctcatccatttttatttgactcccagcacaccctggaatcgctgggggagaagattttattccagagaccagtgaaacacaggtaaaggagaactaacgtgacttacccaaggtcacacagctagttagcagtagatttggagctagagcctagactagggttggcaaacttttcccataaagagccatgtaactatttcaggccttgcaggccacgcattctcactgcaactactcacctacaccacatgatagcatgaaagtggtcacagacaaaacacaaacaagcaagtgctgctgtttgccaatgaacatttaggaacacaaatataaatgtcacatattgtcagatgtcccataatcgtattcatcttctgattctccaccagccatttacaaatgtaaaagccattcttggttggcaggccatgccaacatgtgttgggtcggaactggcccgcagactagagtttgccaatcccagattgctgggagacttctcaatatctactaatagaataccacaaagccaaaaaaagacaaaccgtgatcattcccaggcttattacaattttaactctccagtccagtcaaaattgcttgcctagcaaacaccaaacgtaacccaggctccaggtatctgacagcaatacagcttgcgcatgcaggcggggtgttcaaacttctctagaaaacaatgcctttttatgggaatgcctttttatgggaatttttgcacaaaatttcaagttaagaaactttccataaatacacaacgcatgctctagccacagctggtttcatatgctaactgcagaaggcatttccgaaagcagcatgtgaagagtcctccttaaatacagcgttagggaaaatgacaccctctatcctccccactgcccccaccaccaagaaggaatttgggtctgtgttcagtaagaagaaatctggccagaaaggggttaatgcccttccaggctgggatctgataaatggctgtgcagaaagcaggttccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgg

SEQ ID NO: 1001 - DNA, 1426 bp, Homo sapiens
taagtttaagacagcctggtgaggcccagagcctcaccagtcccccagaaaacggagtattgtttccatccaaaccttgcactgaaaggagcctgtcagcaggaagtgacctcgtgagacaactgtggggagagcaaagggccggggagagaaaggcctcattctcactgcaaacaggaaaaggaaagagaaaaagcaagctctgtctccacacaaggtttgctgggctggctatgaactgttccagtacgttccatcaaatagacgccttcatagaatcaagccgagcgcgaacgccgtgtctggggctcccactcccgggacacacacgcgggctggcttacacatgctcttgctctctcgcgctctgggagagcgcttatatgggcttcatgaggctaagtaataaacactttgtcttcaccctgctatttatgggttgcttggggcatcctgtgctctccactgcccttacctgaacagacggctcatgcagacccggagtttaatagggacaacagtaaatctgagaggctgtgtgtgtcccacgcgctcctgttttcccagccacccatgctagttgcagagaaaagccaacctgtatcccttcgtttatgctctgtgtgcccttcctggaggtgaaatcccttctcctttttcttcgggcccttgttttcttccatcctttcaaacatctctctaacatatccttttgctatttgacccctcccagagatcccttcattcttcagcaatggatcaaagaactctgaaaacaagaacaaccccgacagctgcaaaccacgagccctcacctccagcagaggttttcgggaaactctggacgaccacgcgcatgcagaggtaagggaatgatccggtcctacctggcgttgacttccaggttcactcaaaggccacgtgccaccctttgcacatcgtgtttgggttgcaaaggggaaagatgcatattgaaagccagaagtgtgcccaggccaacagacgtctgaaagccacaggggacgaccctgaaaaagtctggcagatgcagaaccacagctgatcactttggtccgtttgagggcccctttcgctcagctcttttgggggttccagggctctcagagcttccaggtcctgtaagaagagatggagtcatagctgcgccctgtccactctcgggctgtcacacaagcctggagcccagccatttctcggccttgtcttcatcttgggctaaccggtcgtctcctgcaaacagacagcacggagaaggatgagtgaactcggcctctccccacagaatacagttcgccattacagcgctgattaaatacaggacattatctcaccataatgccctcctggcggcgttcccaggaaaattctaactaatcataaaaatagaaagaaaaacgcaacctaa

SEQ ID NO: 1002 - DNA, 34593 bp, Homo sapiens
tgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccattctctctcacagcatattgtatgagactgtgtgagtgctgcttccacgctacactaaaaacccatggtccctgcattatttgagcaactgacaagcttctgaagttcaggttcgcgaacgctgagagcagcacccagtggatttgtggcaggtgagcagatccttctcatctcccattgtggaaatttcacatttcattctgctttgtgaatcccacaacttcatgacaagatagattaacattttgcaaaaaaaataacaaataatgttctgcttgagggaaaatcagacattaggcttcttataagaaacaaggggtcatgttgaagacttcaggataacatatcttggagaagaaaaagccattcagtggttcactccccaagtctgtggcagggtttttttgtttttttgttttttgttttaaaggttattttcataactttgagactacaattaatttctgtaaaacccacggaaaaatagcctcttttcaataatcttccccccatctttttccccaagagtctttaaatctgagaaaatttttcttttcaattaaaacaaaaaattgaacagatgtgcctcaagagggctggcagtacttttaagaactggtaataatttatttagaaccatgtatagtaatataatatatctttatacacaagtcgcacataaacacccactgcttttggtgtggtacttactgttccttgttggaacacccaggaaacttccatatgtcagagatcatgtatgacagtcctatcttctgtgtaaaaggtcatctcccagcagaagaatagctcgcctagttaaagggataccaatttttaaacgctctgccaagctgaagatggagagaatgagtgagagagggagatgtcagatttcaaatgcagggcacgctcattgtgccctcggatgctgagctgggaggagggggagagaaacctctatttagagatgattggaaaaaatcagtgccacacagtgcacttgagaagcaatgcggcaggctattcttgccctctccttggatgtgacaaaatggccaccatggaaacaggaagcagcagcaaatggctgccacaggtcttcttggatgcttgaggaagtgtctatgtgtatccaggcctgtgtggagtattcctagggtagcaggtttttaaagtcagggtgaagaaaagggaggcatttagaaggaatggacaattgacaaagaaagtggtcagacagcaccaaagggtaatgatctgggaaaatccaaggttccaagaaagtacgttgaccccaagaaacttagaatttacagtattttagccaccttgaaactatataaccatgccagctcaagtaaccaaaaatatcctagtccctgcactagccgcttttgaaatatcctgtttaaaatgaccccctcaccaccacgggtaagttgccaggggattggaggctccatggagggctatccctaagccaacctgccaggcaggcaggcaagtttctgccctccccaacctccccctgctagctcctttcctcctgagagtcgaagacttcctgatgttcctggttgcatcagacaccaatctggcccaacttccctattagaaggcctctgtgacaaccagccaatccgatgcaccaatctgagtaactgttttccctccttcaggacatggttacatttagttcgatcttttccttcccaaggcagatgcccaaagcaaaaagagtgaagcagtcagaatttcagacactgtgaacaactccccttggggtacctctggggctggcgtctttacatcacgacgacagaaagctggcccgcacagactatggccacggcgtcttagaggttttgtttctctgcaggcgtccagtgctctgtttctttccctcctcaccactctccaaaccacactcacacaaatacacgtccctatgtgcaaagacgcgcatatgtatattgtatatcagtgtgacactcacacatacgtgcggtgttagcatagcctttccccctcgagtccctgttgtgcttcccagcacccagcatcctccaaagcaggcagtggcacactatcactcataaactaaatccagccactgcctgctttgtaaataaagttttgctggaacacagacctgctgattcgtttgtgtatcgtctggctgcttttgcactagaacggggtggagtagccacaaaaaaagaccatgtggtctgaaatatttgctcactggcacattaagaaaatgtttgctgccctctagtctaaagcagcatcttatatctagaaaatctattccttaaaaattgtcaaaaggtctttctcttatcttaaaagtgattcataaacctgtacctcttagagtcatggagccatgtaattagaaggcgtattttagattgttagtcctacttatggcctagtacgtgattctcttctaggatacctgtggacgtctcatctctcttgatggttccagtaaaaggcaacacacagctgctcacagggaagctgtgatgtttcccaacagctctattggaaagttcttttttatccgcagtgaaaatctgatttcctatcatttccacccactggttcccattctgccctttggggccagtcaggaaaagggggacgatcctttttgaaaaatcggccaggcatggcagctagtgcctgtaatcccaacgctttgggaggcagaggcgggtggatcacttgaggtcaggagttcgagaccagcctggccaacacagtgaaacctcatctctactgaaaatacaaaaattagccaggtgtggtggcgcacgcctgtagtcctggctactcaggaggctaaggcaggagaatcacttgaacttgggaggcggatgttgcagtaagccgagattgcaccactgcactccagcctgggtgacagagcgagactctgtctcaaaaaaataaataaaaaataaaaaaataaagcatcaagtatctggaggtaactggcatgcctcacctttatattttgcttctccaggttaaaaaataacccgtccctctacctgttcctcaggtggtgtggtctcaaggccccaccacctctgtagcatctcttggtggttaatatccctcttaaacttagaaagccatgagtactgtgaagatatcaggtgctttctcaagatgagcattcattcctggtcaccatggtgctgagagttcaccagtgaagtgttagaagcttctggagggcaggagcagaggcttgctgctgtctttctggagcagcaggcacaggcacagggtagccccatcatctcatcgggtcccaagatgccctctgaagctggatatgccaagctttgcaccggtggctggaggcctagcggggattccaccggaaatctggttctagagaatggtatattttgaattaaccactcaacaaatcataaagcaggattgtcagactcattacgggaaaagctgcactgaaaataatgccttaagtatgtgttgttgctgctggggatacaatcggtattagtggcttaaggggctcaggaaatttccatgagaccgtaacaaaggaacagccagcatttggtgggaacaatggaggatggacccttttctttcatcaatgaaaggagatctttcttattatttaaaaatttgcttctccaaacacccacttctccccctggtgtaccatgtcagagttactgaggaggttttaaaaaaaatcattaaacaacccccccaaaagagggctcaatgaggtctcattccgtggtaatgagctccaatttaacgccatcattatttctgacattaaaggcccgagaatagtgtcacatgcccagaagctatttttttttttttaaaccagctaatcccagaaataagaaactgccatgagggacagtgagtcagggcctgtaaaagtgctttaggagaggactgtggcaatagactgacctgagcgtgggaggcacagcctgcacaaggcccttagccaccttgggcggacaggcccagcttgtgcagtgactgtccagtgagtcattaagaccctaggttttggccagacgcggtggctcatgcctgtaattccagcactttgggaggccaaggcatgcagatgagttcaagactagcctggccaacatggtgaaaccccgtgtctactaaaaattagccagccatggtgatggacacctgtaatcccagctactcaggaggctcaggcagaactgcttgaacccaggaggcagaggttgcagtgagccaaggtcatgccactgcactccagtctggttgacagagtaaaactctgtctcaaaaaaaaaaaataagtctaggctttgtgttagattctaagtttgaggcttagctgtgctgcttgtgccaaaaccttatgactttagggaattttacttaagttcctcatgccttggtttggctcatctgtaaaatggaacccataatagtacctactaccaggtggaggcaaaattaaataggatgcagaacacagactctaacatatcaaagagaagaaaggaacctacaggatgatggacagggagggacatctggaagcaacagctgggctccaggcttagagatcaaccagtgccaaggggggcagatcagaaggctctagaagaactttcataagaagacaaaattagtagaatgcccaatatatctggatacattgagagatgatgcacacaaccggggaagacttcaggtatatgtcaatgacagaagactaagaaaagcaaaaacagaaccactgaaaacagagtcatttgggaaaagaagagtaaacagaatatactacatggctcagctaggctaaatattgatctgataaaaatgacaatatcacgatattggcaagatgggaattttatgagggttttttgaaggggaatttaaaagagagctgggccctcatttttcacagtgggaagtcagtagataatgcctagaaataaaaatcaagaaacagcagcaaggccaggcgcagtggctcatggctgtaatcccagcactttgggaggctgaggtgggtggttcacttgaggtcaggagttcaataccagcctggccaacatggtaaaaccccatctctacccaaaaacacaaaaatcagctgggtgtggtggggtgtgcctatagccccagctactcaggaggctgaggcacgggacccttgaaccctggaggtggaggctgcagtaagctgagatcacaccactgtactccagcctgggtgacagaatgagaccctgtctcaaaaaaaaaaaaaaaaaaaaaaaaagagtgaaaaagagaaatagcaacaaaagcattttattgagagatatggaggtaaagttctaaggaatcagtttaaagcactaaaagagtttatccataagggagtaggagctagataggggattttgggggagaaattatatatatttttgcaacaagctggaaggactatataaatctaaaaactgtgtatgtaagtaactttgataacagtaaaactaaataaaattcctattgaaatggaccccatcaattgatttcaccacgagttcctctggatttattaggattaagaccagatttagcagtttctctgttggctgtctcaaccttctaacagatgaaacgtcgaataaggcaggtcaagagcatttccagaagtgtatctttgttttttgtttttttgttttttgagacagtctcactctgttgcccaggctggagtgcagtggcctgatctctgctcaatgcaaactccacttctcaggttcaagtcattctcccgcctcagcctcctgagtagctgggattacaggcacctgccatgacccccagctaatttttgtatttttagtagagatggggtttcaccacattggccaggctggtcttgaacgcctgacctcaggtgacctgcccaccttggcttcccaaagtgctggggttacaggtatgagccaccatgcctggccaggaaagaagtttcattggctcacagctcagcatggctggctgggctcaagcaatccttccatctcagcctccccaaatgttgggattacagatgggagccattgtacccggcccttccttccaatttaagctgaatatttctttggtcaaatcagtatgttgcttgtcagtacattcttgtcagtctcaatgggctgatgactgggcccatgacatcccccatgatcactgacagtattttaccgttcctgatactgcagttcctggtcctcccctttcctccatacaaatgttacattcagtactcccaatctagacagtcgttcatatgctagttcctttgagatcaaaattatgaactcagatttgaagcagagatgagcacataacaaaggtatttgcgctgttcacaacttcaaagtcgctggcgagaaaatcaagttgctactggacgtatgcattccttctcacgtgaatcttccttctgatgctgtgtgctgtttcctagctctgatcacattgaataaactatgaaagttgggacctaatctccaaaacgagaggacaatggttcctgcaggaaaacacattctcttgggagtcaccatagtatccagtgggtaaaagcactgtttcaaaaggaaaaatgctagaaaacactgaagtgttcaattaagaacattaattctttagtggttttctacctgtatgccaacactacagatatcctattatatatatatatatctcatgtatatcatatatgtgatatatatgaatatatgatatatataagatatatataaaatatgtattatatattataaagtatatatatcatatatatcatatatgtgatatatgtatacatatatctgtatgaatctaaaaactgtgtatataagtaactttgataacagtaaaactaaataaaattcctatcgaaatggatcccatcaattgatttcaccaccagttcctctgatttattaggattaagaccagatttagcagtttctctgttggctgtctcaaccttctaacagataaaacgtcgaataaggcaggttaagagcgtttccagaagtgtatctttgttttctgttttttttttttttgagacagtctctgtctcatatctgatacatatttgatatatatatacatatttttctttttgagacagagtcttgctctgttgtccaggctggagtgcagtggtgcgatcttggcccactgcaacctccacctcctggttcaactgatttttgtgcctcatcctcccaagtagctaagattacaggtgccccctaccacgcccagctaattttttgtattttcagtagagatggggtatcatcatgttgaccaggctgcatttgaactcttagccacaagtgatccgcctgcctcggcctcccaaagtgctgggattacaggtgtgagccactgcacccagccctatttaatattttgaaataatactttacatgaacagagacagaaggacaaagatatgcttgtaatggtacagaaaaccctactgaaattataaaaactggtatggtaaataacttcctagattttatattaattgaggctttgacatggtcccaaagtaaattgaactctgtaccccttagataacattttcagtgtacttctatgtgccagacactgacctaagcatcttacatataccatattatgtgacattcttattaactcatttggcagataaggaaaccaaggcccagaagggtaaagacatttgccttgggattgaaagttcacattagtaaagccaggacttgaacccagctgtcatcccaaagaccatgctctttatcactagagcagtggttttcaataaggagtggttttgccccatagagaacatttggcaatatctggagacattttcagtggccatgcctggggctaggagtgcatctggaatccagggtagtctctagaggggagatgtcagggataatgccaaacatactacaatgcacaggacaccctcacaaaaaaggatcatctgggctgagcacagtggctcatgcctgtaatcccagcactttgggaggccgaggcaggtggatcacctctgtcaggagtttgagatgagcctggccaacatggagaaaccctgtctctactaaaaatacaaaaattagccaggtgtggaggcgcttgcctgtagtcccagctactcaggaggctgaggtaggagaatcacttgaacctgggaggcagaggttgcagtgagccgagatcacaccactgcactctagcctgggtgacaaagtgaggatctgtctccaaaaacacccccaaaaaccaatcatctggcccccatgccaagagggtcaccctgcaccgtgctctgcttgtttttctttaagaaattctgaactaattgcccattatcctgtccacagcatctagagttgtagctggcacatagtaggctgttgtctcctaactattagcaaatggattatttttctgaaattattaaagcccctatatggctacataaaaagacaccaattgtttttctttcataagtgattatgtgcctaatactttaaaaaggcctatagacttgaacctcaccacaggtgcttggaacaggggccctgatgtgtaaaactccccagggatggtatacaagtcccacgaatagaccctaattacttaccttaagtgcagatatataagacatctaccaatttgtttccccacacaccagttgtcccacaggactttgttaagtatgcttatatgtacatcttagagttatacttttaacaaggtttagaagaaaacaatgcttactatacacttcttgggttttcttttccctttgttattccataatcatcaccctacctggaataaataggccagggccttagaggaatgtagcaattctgttgaagttatgggaaagtggctgaaggacctaaatggaagatggggagttagaaaatggaaagacacaatattccctgttagcctcccggcgggcatctttctccactcctttctagtttgtatgatgggaagaggcttatgcggaggagaggacagagaattaggtcacacccatgataactgaagattggcttatttatgaatatcttgcacggtgcaagtataccatgtaggctcaaactggagaaggctgtattttaccctcctaacctccttctgcagctttaatgaaagttttcaaaggggaattgacatgtttaattgttaactagaagactcatttattttttttcattcattcattcaacacatactaagtgtgttagtctgttttcacactgctatgaagaactgcctgagactgggtaatttataaaggaaagagatttaactgactcacagttctacaaggctggaaaggaaacttacaatcatggcagaaggcaaaggggaagcaagtacatcttatatggcagcaggagagagagagacagaagggggaagtgtgccagactcttatcaaacaaccagatcttgtgagaactccctcactatcaagagaacagcatgggggaaaccaccaccatgatccaatcacctcccaccaggtccctccctcgacatgtaggggttacaattaaagatgagagttgggtggggacacagggccaaaccatatcactaagcaccagggtatcctcctgagtacacagatggcctacatttcctaacctcatttgtggtgaggtgtggccatgtggatgagttcttaccagcacagatgagcctaagtgacgccaactacttctccgcccagaccttaacactgatcctgtaggtggtggcaatgccccctgcagtgtggaagcagcataaggaaataaacctaagcggctctcttgtgagcaagaaattcacttctttgcttatccagctgctctatttggggacatctttgtcatagcctttgttacttacatggatgtctaatagcagtctatgcactcatggagttcataatctagacagacagtaaataccaaagataatcagggaggcctctctgaggaggtgacatttatgatgagacctgaagagtaaggattatcagccatgcaaagatctgggcgctcaggcagacagcaaaacaaatgcaaaggcagaaattaacttgtgtctgaggaatagaagagtggcatgactggaaggcagtgatggggtcagagggtcactgggtgaggttgagaggaggcagaggaagagtaagtggaggcagttctaagtgtgatgtgaagccactagggtgttttaaagtgggtataggcatgggtgtgtagagagagagggagagaaggaaagagatagtatttgatttgcatactgaagatcacctttggcgatggcatagaaaacagactgcaaggatcaagaatagaaatgagaaaagcgaagacagaatggcagtggttcagtgagcagtgatggtggcttggaccaggctattagcagtggggatgtgggaaagggctggattcagggatgcgtttggagagaaagtcaatggatctgactgacagattggaagtggagggtgaaaaacagttcttatcttgagcaggtgggcagtggtggtatttgttaagctgggcaagactttggggggtcttggaaatgggggggacatcaagaggcctgttttgttttcgcttttgtttcttttggagatggagtctccctctgccacccaggctggagtgcaatggcgcaatcttggctcactgcaacctctgcctcccaggttcaagtgatccttctgcctcagcctcctgagtagctgggattacaggtgtcggccaccatgcccggctaatttttatatttttagtaaagatggggtttcaccacgctggccaggcttgacttgaactcctgccctcaggtgatccacccacctaggcctcccatagtgctgggattacaggcgtgagccactgcacccagccaagaggtctgttttaaaagtgctaagcttgagatgcctgttagaggttgacatggagagtcgggggttcaggagagattactgaggagtcttcggcaaatcaacagaatttaaagccacagacctagatgtgtcctcttagggaaagggaaatgggagaaaaagaggagaagaccagggaaaaagtgtctagcagacatttaggcatcttctcaccagtgtctaggataaacaacacatcagcatttctagggaagtggggaagagcccgcactgttggtaattccaactggcaccatgagaatttctgtgagtgctggtgccggcctgcactggctcatgatagctgtttgttaaattttcaggagttgtgtgagccagttattaaatacagctattattgtggaagtcagggtggagcatttataacacagaaaccagcaaattatccataggaggatctctaaaaatttttgagagcctatctgtaagcacaccactggtccccacataatttgtgtccagacttatcagagaaatggcatgggatccccagatgccatctgactcatttcttacataagccgacccataagcacatcatttgtagtagatgatggcatgatcccattgtctgggaactcctataacactgtgacctccatccactgttgctctcttgccagcacaagtacacttataagtggcagtggttttttttgttttgttttgtttttttgagatggagtctcactcagttgcccaggctggagtgcagtggcacaatctcagctcagtgcaacctctgcctcctgggttcaagcaattctcctgtctcagcctcccaagtagctgggactacaggcatgcaccaccatgccccccgctaattttttttttttttttgtatttttagtagaatcggggtttcgccatgttggccaggccagtctcgaactcctgacctcaggtgatccagttgtcttggcctcccaaagtgctaagattacaggcctgagccactgtgcccggctggcagtggatcttaagcagccctacaaaaatgttaaagggaagggatgggaacctgagtatctggatttttgtggaattaatttttagaaaggtagaatattctctatactaaacaatagtcacaaacgatatgggaacttggggagttcctttcctctgaggcatgggtggaaacactgaggtaaatactttgccccatgaaagaaagcagaggggactccggtttcctggatattcgagacatctctccaaccttggggacacgcagcaccccatgatagcaagtttgttttttataatccttctttttcctccactcagtcttggtattctctctaccacacctatttcattgactctaagatgcgttttcacaaaggtgcaaatgggttgatgagtttattcaggagtattgacatgctacggtgcactggagcatgcagccaatctccctgcacgcttgagtgggccgtggttacctccactgcctccaacaggaatcgagtgctgttttgtctccatgctgggggactggagagatgtgtcattccagcatcaccctaattatgattttcagaagatgtagctgtctggatataacagggccatcaaaagtgtgtggaaagagtgtgtgtgtggtgtgtggagtgtggtgtgtggtgtgtgtgtgtgtgtgtgtgtgtgtgtctagatagcagagggtacacccccagaggctgggcttaagaatgaaatggagttattgcattactgcctgtgcaaagctaagcctgcatgcacagtaacagacgtactgacataggtgctcacacgcatatgtacaaaacccacgagctatcctgagcgaggcttttctttagagatgaatttagtgaatcagagaatgtcaaatctgtaaaaaaaaaaaaaaaaatcaccaaggttatcccacccaaagctttgttgttgttgttgtttcagatgaggaaactgaggcccagagaggttaagtgattgccctgaagccacacagctaaccagagaagatataagttcctgccttccttacttcccattctcataagcaagtttccgcatgaacaaggtggcaggtctgagcaaaatgctaaaactgtggccccattttgtttgtgcacatgtatgtgtgtacatgagctattggtgtgacgggagtttgcggggatattctctccctgttacatgttttcacatttcccacaagacgggaatgaaaaggaaggaagagctgaaccattccctcaggcaagtagatctgtggcaaacaaagagtccacagctcggtctccacgggggtcagtctgacttccttccctcagaagcatcccgggctacattttcatcttcgccgtcttccaatcttgcataatctataataatgtgattccaaatgcattttagcaaatgcaagatggaatgggactcccccggctgctcccgaacatctgatctaagaaacccgtaaggagctgcagtgaaaagttcactgatagaaaaaaacaaacaaacaaacagacatttgcctgtgtccctggttaggggcaaggcttttccgggttggtggctcttggtcatctttgttgtccttaaaaaagggataacgctgaggagctggcggttcacctttgctcttgtgtttaattgctgcaaaagccacttattaccttgtgttcttccgcagagggcacactgtctttcccagccaccaggcctgctggtgtttggcttctctacctgccccggaagccatccccgtcacctccgagtaattctgggtcacttccagggccaggtctgtctggctccggtacaggaaggccctcatgaaaggaagaagggcggaactgggatttttttttctttctttgaattttgcataaaattccgtccccagccacctaatgagaaaacatccatcatctatctttccctgggaatgtcggtggccattctgagctggtttgtggtcccgctcatctgtacgcaggcagggcttgtgaaattgcttttccctcagaaaaatatgttcatttccaccttcctcagatggccctcacaaatgaaagtgctttgtcatttttaatgcccagtgttccctttttcccgcactgtctccagtcacgatccagccgataaaacccacaggtacatttaaaacaaaaaacaaaaaacaaaacacacacacacacacacacacacacacacacacacctcaaaagcccagaggactgtcagattccactggtgtccccttgtgggttttcctggcacacagagcaaaaatggctgcaaggggaggttctctctctgttccctggaaatctccttgggccttgtgcagcatttggatggacacgcagcgacaggggacgtgctgaattctagataacagatgcctgccttaaaatggaggcacaaagcccagccctgtccccttggctggccggctctgagcatcctgagaattaacagaggtacatgtgctttataaaaactggaaagtgtactaaaaattcaaagttattattatttctaaaatgtctccagcctacgatttgtcataaacacctatcattctgcatagataattgggtaattgttcctcatgccagagggaacaaacgtctctctttgaaatgtgtgtggaggcttacacatagagagccctgttataacgagggtctgactccatagagatttgtagatgccaaaagactaacaataacctcctccaaaaaataactgcatccagcttttcataggcaagttagtaggaccacctgattccagcattttaaaagagtcaccctctatatggaaatgtggtcaaaatactagtccaggaaaggaacatgacagatttgttggccaaaacttatttcaaagcagaatctttgtaaaatatgatttttttcccacatatctgcatttcaagactgggttatctttgtttctttgtgattgttatttaaatacatattagttttaacttttcctaccttttcttgatcacaccatccgctgagttaaggatctgtaaacaaagcttgaattgagccaaaatgatctaacttccaaagggaacccttgtttcctcaggtaaacttgaacgtcttcattgatgatagagaaccttgcttctcaaataacctagcatgaagggcaacttggtagttgtttttgttgctaatatccaattccccatggcctgatacttttgtaaaatacataacagttgaattactagaaaaataaaatgtcgcttgaatgttgcagtcatgtcatatggctacaaaagtctttaaactcttaactctgaatttctctacttaacttgttgagaatccctgtcaaatggttaacagaccaggaacgacctgtggacccgctttgagtagcactgaggttgagacagctgtcctgccatcttacccacggtggctcattttccagctatgaaactgctcactccttaacttataagagtttgtcaatccaatgttttaataccttttttaaagcagggacaggtctgtatacaaagcctgcaagctaagtaatcagttgataactgagagggagggctgttaatgtcaatatgagttacacaaagcattgtccaagaataaatcaggaagttaccctaaggtacggcagagggaggggagggcttgggggtggctgtcgtacatatggaaaataaaaaaaaaaacattacagagaagtaattcttaacctgtattccataagacagtagattaagaggtaatagagagagctaacaccaggctggactaaagaactggaagcagagaacatacacaacagtgtaaataggcacacacacgtgtgtgcatgtgtacacgtgtgcatgtgtgtgcatgtgtgtgcacgtgtgggcgcacggtccacctggtgggctggctgattggaactgagtaaggaagggtggaaaaaaggttgagggagcattttcagaaagggggtccaatttatatccgttgcagtaattggtttgtttgtgtggagcaggaagaaggggcagtgggggacgtgatggagtgaaacaccgagggctgcgattcccctgcttgatgagttggagagaaattgttagtaaccaagactggtcccgcaggggttcgttaagtgactggccctccaccatatcctgtcatttccaacctggatgcatcaacattagcccgctttgcggtatgcaattgtgcatctgcacgggtgtgtgaaggcgcaggagcgtctgcgggccgggtctgtgtgcacgtttgtaccttttcttgtggatacagttaagttttccatgggaattagaatcatgaaggccacatgcaatttttttttaaaggcaaaaagcaaaaggtgctttcttactggaaacacaaatttgctgtgacacttcaaaagtaccgtggagttgaacaataggaaaactaagaaagggtctgaactgggcgggctggagggagctgagcactgaaaggctggccggtggcgaacacatccaaatggtaacttcttaagtcagccctgaaagggacagtgagcagtgtttgtctccggattgtgaggcctgtcaacccctgggagacaggggcccagaaactggagttcaggccaagagccaggaaggaaggatcggcaaatttgccaaatgtgcagactgcccacaatgtctgggtgctggtggcatttggagtcacggatgctctgtctttggatcttgggattttttttttccaggcgaaaatggaagaaagactcctgtggggaattttaagggtaggagtccctttgggaaccccataaattcagatcttagaaaagcactgaggaaaaaaaccaaaaatgctttttgcaccagtgggaactctgaggattcagtctcctaagtgctctgcctgtctgggttagccaaggatccagtttcaggggctgggggaaagctaatgccatctaaaggaggccagcccctcccaccccctcaacccacttagctcagtcctggacaaggctggactgtagcctctggacagaggatccccttaaggcacagaagagggctggacttcaacctctattctgtggtttgtaatggtttcctggaatgaacaatcaaaatgtaaaacctgcaagacatgaaagtgaccatctttgagtgctttttctacttcctaaaacagggatgcactctatctgcgcagaggaaaactcgtaggacctcctaggatgcatcttggctccaagttcgtgcagtgttattaggaaattacaagtctaagcagccgcaaagagaccgttaaatcacatcacctgcaggtttgcaaatatatgaagataggcagagctaattgccattattgttgttggtatcattattgttaatagatgccatctgttgatacttcacatcttatacatgtctcattttcatcttcattataagcatgtaacagaaaaaggcaagtactattattatccccgttttacgcataaggacaccaagtctctgagttcaggatgtccccgcgagcccagaccacctgagtccacagccatgctcttagcagcttgttttgctacccctccaagtcctgttaccatttcctaagtgtttcccaggtggaaggcccattcgaagcactttacatacattatctaattatctcatttggtcctcagagccacaaatcaagctaagcagactgcccaacctccaagcacttatgagcttgttgttcccacggagtcacatcatccttagaccatttgcaacggtccaaggtggcagagaaatcacttctgggcatgaatgtggtcattaccaatggccgtgatgggacctggggctgttgctcttcaaggctgatatgagcctctagataactcaggaaggaaacttttaatcctcatcattacaaccatcagtgttgttctgagcatcagcgaccaaagccggaaaggaaataaagaaggactttgagagtcatgtgtgttttgcaatgaaccaaaggcaaatggggctttcctgaattttttaaatttaggggccagaatggaaattattctgtttttttccacatctaccaagaaggactaaggcttagctgtactactttctacgatcctggctgatttttctttttcagtagaataacataaaaaaggaaggccagggtgctctccaaacagaacccagatctaatgaggggattttggagttgtttatatagcatgtctccttatctgtataaagcaaagaacatctccaggtattttcagtggattgatctcatcaagacacagatttattaaaaagaaacacagatagagggaaacaggccactgtaatttatacattagtttttttgttttttgttttttttttttaagaaataaaaactaactccaagttttttagtcattgcaatggggccctgcacatcacgtatgtaatgtaatgacagcttcagactagggatgcttttgatgcattattaaccataaaaaagacattaaataccaggctggaatgccatggggatgcatatttcactaggaattatttttcaatgtatgcttaaagtttattttggtaaacagatgactggaggctgtcagagccggagtaagatttatgttcatttggaatcttcttgaaaggagcggaaatgcctgggacttgtggaacacccacagcaaaatgtaaatcttttcttggccccagggaaggttggagagtgccacacaaacaattcctcctagggatgtgtggtttccaagcagcatcagcgtagatgcccgtaggggcacacgccgggtagagggaacacacattctatcgtctctaggaggagggagcagaacaaaaacatctggactgggaagccggcctcaggatgccccatcagatgcctgcgcatcagctgcaaagaacgccccgaactaattcctccgtttcacagtcacccccatgttggcaccaggagctgtttccttctgtgctgacacatttgtaaagcatttctggttgtggacgtagaacttattgaccatgtgggttttcctatcctttgtaaatgatggaggcatcactgcatccatctacaaagcccttccttggagcttctacagccccaggaaccgtcacagagttacagtcgaggcaggaccaatgggtacctttctgaaactgaagacaatttcagatgatcacagtgtgcacctttagggcctgcttctgcttctttactatttgatacttagtaagtttcatcctaaagacatacccattttggcagatactgacagcttcgcgtagctgctccaggctcaacaattcgtatggaatgctataaattctgtttaacatttgttacatagatacttagctacagattcagagccagatgggcacacctaacccatatgcatctgtaaaatactctcctgcccaaatcctgcctgtatctggaacactctgagtgctcagaagatgttactacaattttagggccgaaggatggtctatttcaggtcaatgatctgtgatttgcactaacagggtattagtggcatgaagatgtctgcaaaagaacagaaagaaagagttgggaatgtattttctttttgcagccttatcatcttgagctttggctggggctggtttatattatctggcgacattcccatttttaaatatggcactgaattagcctaggcactcatgtttcagtttcttagagtaacaattaattgaatcaaggttttggtgatgccctcctccaagggtggctgattctgtagcagcagttctcaaaagaaagggtgattttttcctgcagggcgtatttggcaatgtttacatatatttttggttgttacaacttgggagtgctagagatactcagtgggtggaggccaaggatgctgctaaacattctacactgcacaggacctccctacctccagccaccacggagaatgatccagcctcaaatgccagtcgtgcagaggttagaagccttgttctaagggactgtaaatgcggccgctatgctttgtgactaaaagtagctggaatgacagttcggctgtgtacaatccaaaaccgattgcattggaaaatgagggaagggcctgaatgctggttttccactgaatggtggttcaccccttgggtcctttgttccatggcctgtggtatgatatcatcaatgctctgagacccacacagcttggcagaggacacatcagtagtccaagaaggtgtcactgtgctcattccatggttggagaaatggaggtacagtacagttcaatgacttgcaagagaccacagcatgagggagtggcagggtcaggaacagaccactgagctttccacctttagtctcccacctcctaggctggtgttagaaccaggagatcacactgaacacacacactcgctccctcccttcctctcctgcatatagagatatagcaaatgcaggttaagttgactttaatctttaattcatacacaaggatgtgcagcacagagtgaaataaagagtaaactccagaggcagcaagttctgtaggtttggccagatcttccttttcaaagacagacagcctggggaatcgtgcaaatggtcttccactgccctcttagattctttttatggcaaaatgctggcttttatcaattcctaccccaacctctgattcctacaggctggggaaagcaaacagcagttggggaagtgcatccaccttctcttgtgatggcaacaggagacttggacccctggggaggccaagaggaggggagtgaaaaggggtgagctgcaggagtggatgggggtgggtgggggaagaagctctggttgcagatacctgtgaaacttgtttttttttttttgcttgggtggagggatttggcctgggacccaaacagatggttgttcattctgaccccctaataggcatttctgcattaaatgatatcagagtggacacaggagaaagaaaagtctattgttgtgtccaccataaaaatagacgtgtggatgaaatgatcttggagcagaatcgactagagagggtgaacttgggcagaagaaatcaactcggacaagccagagtccctgacaaggtcgtgaggtctcaagccaatgggatgacataaaaaggtatttggatgccaataactgtaaccagcagcagatgcagctgctactggttcctcattgacacgtccacccttccttttcatccccagtgcagtccagccaagaaataaaggcaacttggaatcccaacagctggaagtgctgcagttccatatgtgtcaattgtctggaagcctctgggctgggaatacttactcctttgggaatgagaggaacacgagcagagcggggctttggaaatccgttcccagctagctgaacttggggccctctaggcttgaagtcaggacagcggtggcctggacatttccagggagtggcccacagggttgggtcattggccagatgctgctgtgtgccagggtctgagcccttgctcagaaaagagacaggcatggctttgcatggaactcaggtgtttggtcctctcccatgggagaggaccacaagcggcatcaaattccagcgaggcaaccgaagttgtcctcatcttccagacctgctcaaactttatagacatgaacgccaaagattatcccaccccgccaaaaaaaatgttggctctctccccattcatttcaggatggccttgtgcaagggactcccactgttagtttaaacacttcgttctctgcattcaatccagggattcattcatttggtcaaggtcagccacagtaaagtagaagtgttaacttatctgctatattagcattcacccaaatgagcagcttacttgctaccaagccaactattaataccttttggtttatagcaccaaggtacagcattgcagagaataagccaggagaaaatgtcctgacctttaaaagcttagggttccctggagaccccagtgacatatctcagcaaggagaagagatatcctggctgagtcctcaaccctgggtgtggccaaagacaagaaaatatggtttcatttggtctggggacagccatgccttggatacatggtaagaaatcttgactcctggaacatgcttgcacctttccttttaagaactgttttcatgccccagttataacagcttttatccaaaagacaggcaataacaaatgctggcaaggatgtggagaaaaggaaacattgcataccactggtgggaatgtaaattagtacaaccactatggagaacagtttggaggttcttcaaaacgcgaaaaatagagctaccatatggtccagcaatcccactgctgggtataatccccaagaagggaaattagtatatcaaagaaatatctgtactctcatgtttattgcagcactgttcacaacagccaagatttggaagtgacctaagggtacatgacgaatggataaagaaaatgttgtacataacacaatggagtactattcaaccataaaaagaatgagatcctataatttgcagcaacatagatggaactgaaggacattatgtcaagtgaaatagccaggaacagaaagacaaacttcacatgttctcacctacttgtgggagctaaaaatgaacaacaattgaactcacggagataaagaaagagagtaggttgatggttaccagaggctgggaagggtagtgggtggggcaggggggtgggtgcaggtgggaagtggggatggttaatggctacaaaaatgtagttagatagaataaataagatctagtatttgacagcaccataaggtgactaaagtcaacaataatttattgtacattcaaaaataactgcaagaggcaggcatggtggctcacacctgtaatcccagcactttgggaggcccaggtgggtggatcacctgaggtcaggagtttgagaccagtctgaccaacatggtgaaaccccatctctactaaaaatacaaaaattagctaggcgtggtagcagctgcctgtaatgccagctactcaggaggctgaggcaggagaatcacttgaacccgggaggcagaggttgcagtgagccaagatcgcaccattgcactccagcctgggcaacacagagagactctgtctcaaaacaaaacaaatcaaaacaaaacaaaactacaagagtacgattgaattgtttgtaatacaaagaaaggctaaatgcatgaggtgatgggtaccccatttaccctgatgtggttattatgcattgtatgcctgtataaaagtgtcttatgtaccccaaaaatatatatataactactgtgtatccacaattaagaaaaaagtcttcagtttgtagccacagcccagatgagtgctgtcccatctcctgctcttggaccagtgtgatctgaaaggatgacatccagtagatggaggaaggacccaacaagagaggctgcatcctctgatgatactaatggtattcctaagaatgaagaatcacagcttttactatctactaagtataaaacatgtgtgttacacacacaagcatgattccatctccttcccgtaacaacccatgggtgatgggaaactaaagcacacagactcaaagtaacttgcccaggttcacagtggcaggtgcagaactacagcccagcaccgaataatcaaaatgccaggctataaatatccagttgtcatcccaccgacatagcacagagctctgatacataagatggatatgggttgctctcctagagctgccgatggcattgagcacttctgaatatgtcacggatggccaccaactggacagctttcatgctgctggaattttaaagacagggccctgtgacagagaatccgaagagactgggaacaaccacaagctagagttgacttcagaaatgctgatgtgaatttccgactttagaacctcagtccttggccaaaaatgtcctcaattttttgacttcttgtacagtgggatttaaagagattagcaattaaattttataggagatttgtgtattattgttaaaatttcatcagaaattggcacctgccctttgaaatatgcacataaactattccctgaagtatgatttttcaagagtgttgttgaacaaaaatctttatctgtgggaatacctttctgaaattttaatggccatcaaatgggaatatatgattctctccacaaaaattccatttatacttctttgttttttttcaggatcacattaagtgaaatatgaccatatacagcaaagatgtcatgggtaggacccataagtgtatctgtatgcctgtgagggtgttggggtataagtttaccttgttttaaaattttaaaattaactatcagcatataaaatccaggagatagtacataaaaattcagatcgatggcttctcttgaaaacatggaatattttgaaccctgggtggacatgtgactgaagcttagtgcaagctggtcctttttatgggacatgtaccctgcaggttactgccacgcccagcatccttactcctgttgtgtttcatgaatttctatggcctgcctgtctccttagacatttgagtgtgtgacctccagtctacatgatagcaggtgcctccatgtgtggaaataagtctttcttggttcctttgttgatgtatttagtttctattggggctaaaacttaaggaagagcaattaaagacctctaagacagataggcagtcttccaaagactttccaataaaaataaatatcagccaggatctgtggcttatgtctgtaatcccagcacttgggagagcgaggcaggtggatcacttgagcccaggagtttgagaccagcctgggtaacaagatgaaacccagtctttacaaaaaatgcaaaaattagccggacatagtggcgcacacctgtaatcccagctacctcaggaggctgagaagggaggatcatctgagcctgggaggtcaaggctacagtgagccataatcacgccacggcactccaccctgggcaacagagtgagagactgtttcaaaaaaaaaaaaaaaaaaaaaaagtaaatgtcagagaatgtgtttgtctcctgaagtccctgcactagtgcacactgtacccattccacctgaattgccatggcagaccagacccttgctcagtttgtcatggccatgttctttgtgcttccctcattcttgcttacagtagacaactccctcccctcccctccccttcctttccctccatcatccaccttatcctcttccatcccggcctcatactttgcctcagggcaaggtctgtagtgttaagactgccgatggcctgagagaagaggccgatgaacccctggggctgctattagtatcggactttagacacattacaagttaaataggcttttgtgggctggcgggagatacaaccaccatgcgtgatactgtttctgggggagtatttcacccaggttccgaacaacagacttaaaatgaacttctgcaacatcatagcctattagtacattggattcttccaaattctagaagataattgggctttcttatttgcaacgtgttttcttagggcaagatctatatctgtctctctgtgctacgctgttgaagagcaataatacagatgcatttatggatcttaacaggagcgatcaactcaccaactatagctaagggcccaccgtgtgcaaagtactgggggaaaaatgtatagaaagctgccttgcaggagttcacaatacagtgtgcgtgttgggcacgaaggtggaaatggggcaaatagatggattactggcgattatgaatgatatcagagaaggccacagagattcagaaaatagcaggactagagacattcttatgaagaagatggtttggaatgaaagtgaaaaaataggtaatagttcaagaggcccttgccatcaatgacgtgggattccccaggcattccagacacagaacagagcaaagaacagcacaggagtgagaaagttcaaaggaaacttgggaaacagaggggaggctggtttgggtgaaatgtgacctgtacataagggagtgaaggaggatgaggctggaagagtgagttgggactgtgttggagagggctctgggcaccttgcggaaggactgccatgtaattgaccccaagacatagcaggcctgcgtgtggacagattggagggcagtgagaccagatgtggaaacagcacttagaagctcctacaattagcaaaaggcaatcagtagctctatgctgggggctggggtggaggagagaggcaatcgaagtgagaacattgtggttttggggaaatctcaagaactctcccagatcttggtgctgatgatgtcatttatctaacaatattattctgatacagtcactaaaccatccatccatctatccatccactgaacaagtatttgcatacctaggggcattgttcatgttatgcatttgatttggaaatttttctacacgtatgtaatgagttcaaggtcaaagactggagaaaccaaatgttctaagatgatttgcccaagtaaaaatgctctgcatattataaacaatgtttctcaaattgtgatcattggattattagaatgaaggatactttaagaaaacaaagattcaatattcaaagtttttatgcctcccttggtaaatcccaacacccatacaaatgatcaaaggccctgacaagtcctgcagttaaaaacaaaagtaaacaaaaaaactgtttaacctttcgcagttcacactttgaccacaggactcttttactgaataatatctactaaccttccaagaaacacattatgaaaaatattgttacaaagtagtatataaacttaaggcatagaccttcaagtgtagttactccttttaggttacctctagctccaaccattacctgaaaggtaaatgaaagggaccataattcagggtataacccacacagagataatttctaccttttaaccatttattgctgcatcacagattatcgaccacctactatgtgccaggcactatgtatggaattcacagtacagcagtcactaagagatgtttgtccctgtctgtaaagaactaaacttacagtttaatcagtaacaccaaatcttcactacaaggtgggacaaattggccactcgttctcctaccctcactttccctgtgattctccaacttatatttaccaaagcagttttattacagtgatatttcaaaagttctttatttaaaaagggtaattaagaggtaggatcccactgggggaaatgagaggccaagatgagagaattgcttgagcccagaagtttgagaccagcctgagcaacatagggagacccccatctctacaaaaatttaaaataatccaccaggcatgggggcacgtgcctatggtcccagctgcttgtgaggctgaggtgggaagaacttgagcctgggaggttgaggctgcagtgagctgtgattgcgccaccgcactttagactgggtgatagagtgagatcccgtctgaaacaaaacaaaacaaaacaagaggctggatcccaaaccagtacattcctctattagccagcagaggtgagaacagactagctaggaaaggagtttcacaagaactggctcgaataaccccagctggggacaaattttgattttcctcatctctggattcttctctctctttaacaaagaccactacccatgatcaattcctgggtgtctagcccaatccagcattcacagttcattcctgggagccaaagttcccttttgtagttccaaatgtttctctctcagttttttattttatttttttaaaataatgaccgatgttctaaaatcagctagcaagataggcaaaataatcagtaatttctaattgtatatttaaaatatcaatacgaagtggttctgggctgcaaaccagaagaaacagacttggcttataagacattaagaaaatttttagtcttgaggtctgcatgttttgtgagctttatatagaggataaaagtgaaacttcagcttttaagccatgctgttaaaaattatatttacatccagtataattctgcaaccattaagccttaaatgggtattaagcctgattcaaagtaatgaaacagatggtggaaacacacactatggattcttcaatctggggagaaaagggctgattcatctgtttcaagggccaggcaaagataaaagacttcatcccaaatggagctgcttcctcctcaaaccttagcattccctccaatgtatttctccgtgtggaaagtattattaatgtcagtatccccagtgcttgtaaaagattcataggccatttcctccccttactgaattcccctgtctgtcccgtcaccgccccatgttcgttcatctcactgttgggcagtttggtgacgccagttgcagattccatcacaacccagctgcctgtcataggatcacagcattttagagctggaaggggcttagagatggcattttcagaagagaaaatggggctgggcacagtggctcatgcctgtaatcccagcactttgggaggccaaggttggtggatcacctgaggtcaggagttcaagactagcctggccaacatggtgaaaccccatctctactaaaaatacaaaaattagctgagtgaggtgatgggcacctgtaatcccagctactcgggaggctggggcaggagaatcgcttgaacccgggaggtggaggttgtgctgagccgagagataatgccattgcactccagcctggacaacaagagcaagactccatctcaaaaaaaaaaaaaaaacaaaaaacggaaaacaaacaaacaaaaaacagagagaaaacagaagctcaaaggacagtgacttgttcaaagtcacacagtgagcacagactgggatcactgtaggcatttttattcctttgcttgtcttctttctcctcttctttcccacttctgaaaatatttacagaatcctttatagggaccagggtgggaaattaggagaaattctacaaggtgagaataaaaatgttgtagacagtcagcccaaaggttgtgggagtgctgatgaataaaggtagatggaatgggaggactagaaaaccagtattggactcattcattatgaaaattaatttctaactttagggggaacatggaaaagtccctgtgaggataccacagtcataaatgtcgtaggcaagaccggtgctgccaggggtactcaatttagcagacgaaagttgagaagtcggccggacgcggtggctcacgcctgtaatcccagcactttgggaggccgaggcgggtggaccacgaggtcaggagatcgagaccatcctggctaacatggtgaaacccccgtctctactaaaaatacaaaaaattagccgggtgcggtggcgggcgcctgtagtcccagctaccagggaggctgaagcaggagaatggcgtgaactcgggaggcggagcctgcagtgagccgagatcgcgccactgcactccagcctgggcgacagagcgagactccgtctcaaacagaaaaaaaagcaagttgaggagtaggatattatcatcatctcaacgtacctcccaaaatatacttaacagtttcaaagggaaaaacagtaactttgcggcatgaaaacctggcagataccaccttacccaagtgaccaaagggactatcagttataagccaaactgacatcacgcaccccgcatataataccctgagaagggcacgtcacctctgctattgctgcccaaaacatacgcatgtcttcgatcaaatcatgagaaccttcctatacattctatccagtcatggagcaatactttttcaagtgtccaggtgtgaaaaacaagggaggactgagaggctgtcatagattaagggagctgaaggaaacacagctaaaagctgtcttacatttaggattgtggataggatccaagaaacaggacgtgagtgaaaacaccggtgaaatccaaatacaatctatactttggtattagtattgtacccattaattaagaaaaggaattttttcttttcttttttttttttttttttggagacagggtcttgctatgtcgcccagtttgtcttcaaactcctgggctcaagtgatcctcctgcctcagcctcctgagtacctaggattccaagtatgcaccaccatgcccagccgatttcctaattttgatagttgcaccacagttatctaggatttttatcattggggaagttgggtgaggaatacacagaaactctctgaacaatttttgcaaattttttgttgtctaaaataatttaaaaataattttttaaaaaggaaaaagaggctgggtgcggtggctcacgcctgtaatcccagtactagtactttgggaggctgaagcgggtggatcacgaggttgggatatcgagaccatcctggctaacacagtgaaaccccgtctctataaaaaataaaaaataaataaaaaaataaaaaattagccgggcatggtggcaggcgcctgtagtcccagctcctcgggaggctgaggcatgagaatggcgtgaacccaggaggcggagcttgcagtgagctgagatcgcgccactgcactccagcctgggcaacagagcgagactccatctcaaaaaaaaaaaaaaaaaaaaaaaaggaaaaagaaaaggctgtgggatgcaaggaaagacagtaagtcatgggatggagctataaagcacagcagctgaccattccttctagaaccttctaaatcctaaaagatggacagaggccactgggaactcgctatttcccttttgggttaatcagaacttgtacgttattatagccataacattcacaagttagataaacttctgagaataagccccagggcgtggaagggattaaggaagagtccgatttcctcatcagttgcagctggtagacggtggtaccaggacttctgttgagtgactttggggcagccgccctacaggctcaactcccagaagctacctggcccgatcacctggaatagggagtccccctgtcacgggaaaggatgagaagtgggtacccagggaaggagtggtggggggaagaggacatctttgttcaggctgtgtttgttctacatagtgtgtatatgtttctgacaatgaaatgtgttcttggaaatgtccccttcatttatagatgtatcactgcagagtatgtgtgagaaaaagaaagagacatgtcagaatcccacagacaacagcttagccctgccttccattatatatacaaagtgttgtgtacgttagtgatacatttgcagaaggggtgggaatgtggctttgtccgtatttccaaatgtaaaacaggtctcccatcccctctgtttggttgtggctgtttccttacagaatgaaaatactggcattggaggcactgttgccagaaacttgcttggcaaaacatttacattcctttgtacatatatataaacaaaatcacttcttccaatggatactttttcacgtcctccctgatttctgtggtaataatgaccacatttggctccaaacctggggatgtggtagagaaagccacctcccaattccagatcctgaaatctcgtggaagattaacatggacgtcaaactgacgttaccaatttaagggatttaaacactcagctctagagtaaacaaaatccagtggcaaggttttggacaacttcagcgacgtttgacaacacaacccagatgttggggagtgcaaaccttgtaaacgtaggctttccactgtgttctgtacaagcaagatgttgagtgagacagaccggctaatgaaggaaagaagtactgataattattgagtgacttttatggggcagatagtatgctaagtgcgccatagacactgtctcactcaccatttgcaatgaggtagctattatttattgatatggacatgaggctcagaaatctgcaatttgcctcacttggcaagtgacaacatcagtatttgactcatgtgagtgtgactttaaaacctttgctatttccagaagtcaacactgactgtatgtaacattcctttgcttaaaacctcccagtttctctcactgccactagatcagtgactgtctcagctcagcctttgatgccttggtggtggcccctgctgccccacagaactaaaagctatttacgtaaggctggggctctcttaaaaatgtggttccctcagtcttcccacctttgctagcatttactatatgccatatgattttttttttgagatggggtctcgctatgttgcccaggctggacttgaactgctgagctcaagccatcctcccacctgcctcagcctctcaaatagctgggatcataggtgcgcccctccgtgcccagctttggctatgtgatttcttcattcacaagtctgcctgggactccttgtccataagggtgttgatactttttgaatctaatgatactatgtgcttagtggttaatacctgcttcttgctgagtgaatgaatgagaattaacatatatatatatagatagataatttttttttttttctggagacagggtctcactctgtcacccaggctggagtccagaggcgtgatcacagatcactgaagtctcgacctcctgagctcaagtaatcctcccacctcagtcttccaagtacctgggactaaaggcatgcaccactactcctggctaattttttgtactttttctagggacagcgtttcactatgttgtccaggcttgtttcaaactcctgggctcaagccatcagcctgcctcaacctcctaaagtgctgacattacaggcatgagccactgtgcccagccaggaaatgtttcaaatacttgaggtaataaatatttttaaattttatataagattctgtgtaagtgctatgaatgttacaactcattgtgaataatttactaaagcagaattcctaaagattcatattagatagtatctaatggttttatttcagtggttctgagctggggttattttgacacccctgcccaggggacatctggcaacgtcttgagacatgtgggttatcaccactgcagggaaggcggcgtcgctggcattatcgggtagatgccagggattctgctaagcatcctacaatgccctagaaactccctccaatgccagtcctcccaaacaaagcgcatattgccaagacggaataaccctgctttgtttgatgtaatgacatggcatatacttgaaggcagtcaaactacggttcatttgtttttttgttttatttcagatttttgatgaaccaagctggctggtgtcgcctcagtttgtctaaattaccaaggaccgctggaatttccctgggaatatgtttcgggaaaggtcagaaactcttcagtcgtcttcacgcttccactcagtagcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttctgcactaaattaactccataacgtagtataaacagaacaagcttgtgtgtgatatgcttaactgttaatttacctaattaaactaattcaattaaatcatttacatctttttggtaacatgccagttgataccacagcagaagtgggatgtttcagaagatgattgttcagcaaatgaatggaaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccaca
